United States Patent 7,514,209 (DIAGNOSIS AND PROGNOSIS OF BREAST CANCER PATIENTS) - sequence listing, part 2

SEQ ID NO: 991 - DNA, 2107 bp, Homo sapiens
  ref <308>: DATABASE ACCESSION NUMBER: NM_004120
  ref <309>: DATABASE ENTRY DATE: 2001-06-18
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgtttt

SEQ ID NO: 992 - DNA, 960 bp, Homo sapiens
  ref <308>: DATABASE ACCESSION NUMBER: NM_004131
  ref <309>: DATABASE ENTRY DATE: 2001-06-18
agcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 993 - DNA, 853 bp, Homo sapiens
  ref <308>: DATABASE ACCESSION NUMBER: NM_004143
  ref <309>: DATABASE ENTRY DATE: 2001-06-18
agtggcaccgctgactgccgagaggaagctcgcctctgcccggctgccctcttgtagtccgccggcgaggggcagttctcggtgaggaggaagagagcagcggacggcacagcacccgcgcgggccctcccacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagag

SEQ ID NO: 994 - DNA, 1832 bp, Homo sapiens
  ref <308>: DATABASE ACCESSION NUMBER: NM_004154
  ref <309>: DATABASE ENTRY DATE: 2001-06-18
aaggacagaggaggggcccttcctgtcagctggctgggagcagaggtggctttgtcttttcggaagaactggttctgtggaatttgtgcttatttcccatcaaggatcaaggacctgctctggggctacctcagggccccacaggatgaggggctggttttcagatgagttttctgcttgcctgtcatctggatagtgtctaaaaatttgcaaactgccttcttgtcagtgtcttgctcattcttcatgacactcctgatatgtctctcagtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaa

SEQ ID NO: 995 - DNA, 1042 bp, Homo sapiens
  ref <308>: DATABASE ACCESSION NUMBER: NM_004163
  ref <309>: DATABASE ENTRY DATE: 2001-06-18
ggcttgggaaggggaaggaaacttctctgaaatctgaacacctgctctcccggcaaggaaacttcgaaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatggatactcaatttgttttttcttatagagaaaatgagtatatagacatatacagagaat

SEQ ID NO: 996 - DNA, 1674 bp, Homo sapiens
  ref <308>: DATABASE ACCESSION NUMBER: NM_004170
  ref <309>: DATABASE ENTRY DATE: 2001-06-18
atagcggcgacagccatggggaaaccggcgaggaaaggatgcccgagttggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggaccgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttcgtgagagtcatctcaaacacggcttaaggaaaagagaaa

SEQ ID NO: 997 - DNA, 3871 bp, Homo sapiens
  ref <308>: DATABASE ACCESSION NUMBER: NM_004172
  ref <309>: DATABASE ENTRY DATE: 2001-06-18
gcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaattcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtagtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 998 - DNA, 4154 bp, Homo sapiens
  ref <308>: DATABASE ACCESSION NUMBER: NM_004176
  ref <309>: DATABASE ENTRY DATE: 2001-06-18
taacgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcgccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttata

SEQ ID NO: 999 - DNA, 1559 bp, Homo sapiens
  ref <308>: DATABASE ACCESSION NUMBER: NM_004180
  ref <309>: DATABASE ENTRY DATE: 2001-06-18
gtttgagcagcattgttagagcctgtggaaaacactttacaactgtgtaactgtcttcatctttacagaggaatagtctacaaggaagacttgtaacctggagaagagacctgtcatttactacatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccctaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttattggaaaatctagtttcacagctatttg

SEQ ID NO: 1000 - DNA, 1014 bp, Homo sapiens
  ref <308>: DATABASE ACCESSION NUMBER: NM_004181
  ref <309>: DATABASE ENTRY DATE: 2001-06-18
gcagaaatagcctagggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtgtgcagagaattcaccgagcgtgagcaaggagaagtccgcttctctgccgtggctctctgcaaggcagcctaatgctctgtgggagggactttgctgatttcccctcttcccttcaacatgaaaatatataccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggttatgttgtcctaaagaataaattttgctgatagtagc

SEQ ID NO: 1001 - DNA, 2693 bp, Homo sapiens
  ref <308>: DATABASE ACCESSION NUMBER: NM_004184
  ref <309>: DATABASE ENTRY DATE: 2001-06-18
cgaaaaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatggcgatgctgttgagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgacccaaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagccttcggctggaagtccatgggccaccctgttcttgtccatggaggacttccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtcctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctaaaaaa

SEQ ID NO: 1002 - DNA, 1881 bp, Homo sapiens
  ref <308>: DATABASE ACCESSION NUMBER: NM_004203
  ref <309>: DATABASE ENTRY DATE: 2001-06-18
gatatcgaattccggaattccccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcggaattcc

SEQ ID NO: 1003 - DNA, 1982 bp, Homo sapiens
  ref <308>: DATABASE ACCESSION NUMBER: NM_004207
  ref <309>: DATABASE ENTRY DATE: 2001-06-18
ggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttctcgtgccgaattcaaaaagctt

SEQ ID NO: 1004 - DNA, 1224 bp, Homo sapiens
  ref <308>: DATABASE ACCESSION NUMBER: NM_004217
  ref <309>: DATABASE ENTRY DATE: 2001-06-18
ggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgt

SEQ ID NO: 1005 - DNA, 728 bp, Homo sapiens
  ref <308>: DATABASE ACCESSION NUMBER: NM_004219
  ref <309>: DATABASE ENTRY DATE: 2001-06-18
gcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattcttcaacagaaaaaaaaaaaaaaaaa

SEQ ID NO: 1006 - DNA, 958 bp, Homo sapiens
  ref <308>: DATABASE ACCESSION NUMBER: NM_004221
  ref <309>: DATABASE ENTRY DATE: 2001-06-18
tctaaagctcagtggagctgggtcatctcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtracaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcagggagataccatg

SEQ ID NO: 1007 - DNA, 2304 bp, Homo sapiens
  ref <308>: DATABASE ACCESSION NUMBER: NM_004233
  ref <309>: DATABASE ENTRY DATE: 2001-06-18
cacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcatttattgctgagttatatgttcactgtccccctaatattagggagtaaaacggataccaagttgatttagtgtttttacctctgtcttggctttcatgttattaaacgtatgcatgtgaagaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaaa

SEQ ID NO: 1008 - DNA, 3703 bp, Homo sapiens
  ref <308>: DATABASE ACCESSION NUMBER: NM_004244
  ref <309>: DATABASE ENTRY DATE: 2001-06-18
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttaaa

SEQ ID NO: 1009 - DNA, 2000 bp, Homo sapiens
  ref <308>: DATABASE ACCESSION NUMBER: NM_004252
  ref <309>: DATABASE ENTRY DATE: 2001-06-18
cttggcacgagggattggtctgtgctcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttatcctgaaccttggcagacacgtcttgttttcatttgattttgttaagagtgcagtattgcagagtctagaggaatttttgtttccttgattaacatgattttcctggttgttaatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaccaaaaaaaaaaaaaaaa

SEQ ID NO: 1010 - DNA, 3149 bp, Homo sapiens
  ref <308>: DATABASE ACCESSION NUMBER: NM_004265
  ref <309>: DATABASE ENTRY DATE: 2001-06-18
agggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctc

SEQ ID NO: 1011 - DNA, 2393 bp, Homo sapiens
  ref <308>: DATABASE ACCESSION NUMBER: NM_004267
  ref <309>: DATABASE ENTRY DATE: 2001-06-18
cgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagcgcagccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcaagctgggggcgcccagggccgcctccggccgggccgccccgtgctcatgcccgtttggacctccgcactccttaccgccctcccgctgccgccgtcggggcgatactctgcagccgcggcagggatggcgggggttgcggcccctccaggcaatggcactcggggcaccggagggcgtcggggacaagcggcactggatgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttcctaaaagtagacttttgtgtaaaaagcaaaggttacatgtgagtattaataaagaagataataaat

SEQ ID NO: 1012 - DNA, 2605 bp, Homo sapiens
  ref <308>: DATABASE ACCESSION NUMBER: NM_004281
  ref <309>: DATABASE ENTRY DATE: 2001-06-18
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaaaaaaaaaaaaaaaaaaaaaaaaaaaaaaaaaaaaaaa

SEQ ID NO: 1013 - DNA, 2174 bp, Homo sapiens
  ref <308>: DATABASE ACCESSION NUMBER: NM_004289
  ref <309>: DATABASE ENTRY DATE: 2001-06-18
gccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttct

SEQ ID NO: 1014 - DNA, 1999 bp, Homo sapiens
  ref <308>: DATABASE ACCESSION NUMBER: NM_004295
  ref <309>: DATABASE ENTRY DATE: 2001-06-18
gccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcgggggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttatt

SEQ ID NO: 1015 - DNA, 4200 bp, Homo sapiens
  ref <308>: DATABASE ACCESSION NUMBER: NM_004298
  ref <309>: DATABASE ENTRY DATE: 2001-06-18
gactctcgcctgacttcctaatttgctacttatccccagcgttggtcccggcgaggatatgctgagatttatggcactgttggctgcatttttggagaacagcaagcagcttcttttcagataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattgcctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccag

SEQ ID NO: 1016 - DNA, 1842 bp, Homo sapiens
  ref <308>: DATABASE ACCESSION NUMBER: NM_004301
  ref <309>: DATABASE ENTRY DATE: 2001-06-18
ccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttatgcatatttcaatttccacttaaatttatttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgcttttattgactagtaaaagttactgcctagtctttttaccttaggcttacagaattaaataaaaattagccattccagaaatataaaaaaaaaaaaaaaaaaaa

SEQ ID NO: 1017 - DNA, 1921 bp, Homo sapiens
  ref <308>: DATABASE ACCESSION NUMBER: NM_004305
  ref <309>: DATABASE ENTRY DATE: 2001-06-18
ccccgcgcgagagcggcccttgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagtttaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatacttaactgaagcttcggccgcaccacccggggaagggtcctcttttcctggcagctgctgtgggtggggcccagacaccagcctagcctgctctgccccgcagacggtctgtgtgctgtttgaaaataaatcttagtgttcaaaacaaaatgaaacaaaaaaaaaaatgataaaaactctcaaaaaaacaaggaattc

SEQ ID NO: 1018 - DNA, 900 bp, Homo sapiens
  ref <308>: DATABASE ACCESSION NUMBER: NM_004311
  ref <309>: DATABASE ENTRY DATE: 2001-06-18
gggactcggcggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcgggccttaaaaacactaatttgctgctttctgaccaaatgtttttcatctgtgtacactccagctgtttgaagagagggaacaacacggtttagaaagaatccccattccagcagtagatttaactgatctctgaggttcagtatcatttttcaaataaaggaattatattatttcctctgcataattgaaatagtattaaatgtctaaagcacatgattagaaaatgagatcttttaaatgagcaagagattgcattgcagtttagacaattccagtgggctttttttttcg

SEQ ID NO: 1019 - DNA, 2333 bp, Homo sapiens
  ref <308>: DATABASE ACCESSION NUMBER: NM_004315
  ref <309>: DATABASE ENTRY DATE: 2001-06-18
ggcacgaggctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatctttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatattattttattacatatcattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattgatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgataaaaaaaaaaaaaaaaaa

SEQ ID NO: 1020 - DNA, 1311 bp, Homo sapiens
  ref <308>: DATABASE ACCESSION NUMBER: NM_004323
  ref <309>: DATABASE ENTRY DATE: 2001-06-18
tagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggatcggaatttacctgatttcttcagggctgctgggggcaactggccatttgccaattttcctactctcacactggttctcaatgaaaaatagtgtctttgtgatttgagtaaagctcctattctgtttttcacaaaaaaaaaaaaa

SEQ ID NO: 1021 - DNA, 2382 bp, Homo sapiens
  ref <308>: DATABASE ACCESSION NUMBER: NM_004330
  ref <309>: DATABASE ENTRY DATE: 2001-06-18
agtaccgctgcggccgggggattgggccggggtctccaccgccgaccgaggggagcggcgtccgctcggccctgctttttgcgacctgccgtcagccccacgtcgccggcctggaggggcgaagaggacgaggggcgcaaggcttcctccggggacattggctccctggattatcaagcagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtatttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttcaatgtgtacctgtcttatggaagaaatatgcaggtatataagaccacgattttctaagctgccatataagaatttttgtttttgtaaatggttaaatacatttcctgggtaacttaggaaattaagctttttcataaggcaacagatggtaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagcagggtcggaattacgggtttgtatatatgtatatactcgtttgtatatatgtatatactgggacattttatcttctggcccaaagtcagaactttataaaaatcttgagtttgttcacttaatgtgaaataagctatgtgtccagggtattgctcccctgagtgtatatgagtgctgagtagtattgcagagaatgtgatgagttatcactgtcacaactttttctatagaaaacaggggctgcttttaaactctcactatgggacactttaccaaaatacttccatatcaattatttgaacccggtagtttgtttgacctagttagattgtggtgtttattcaagtttgaaatcatgtttgacaatactgtaaattaggttaattttgaagtcttagcatcatcatattgtgctgttttggataacacgtttgttcaagaacatttaaactgtttctttggtgtcctttacattgaaataaattgtgtttgtgcctcc

SEQ ID NO: 1022 - DNA, 3446 bp, Homo sapiens
  ref <308>: DATABASE ACCESSION NUMBER: NM_004336
  ref <309>: DATABASE ENTRY DATE: 2001-06-18
ttctagtttgcggttcaggtttgccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaa

SEQ ID NO: 1023 - DNA, 8093 bp, Homo sapiens
  ref <308>: DATABASE ACCESSION NUMBER: NM_004338
  ref <309>: DATABASE ENTRY DATE: 2001-06-18
ctcagctccctgtggtgggggatggcagaggcttcccgctccccgcagctggtttgcacagcctcccgactgtgccgtggtgtctccttccctaaagtgggacagtcgtttctgtgtcctgctggcctctgaggaacagacgtgtgtgagaggccttcagggcctgatggctggggtggtgacagtgcctggagaatgggtggggactggaggggccaggtggctaaccactctcctcttccatggcagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcaygaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacmcaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggagacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 1024 - DNA, 3809 bp, Homo sapiens
  ref <308>: DATABASE ACCESSION NUMBER: NM_004350
  ref <309>: DATABASE ENTRY DATE: 2001-06-18
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacggtcccaggcccagagaagatgagtctatggcatcaggttcttaaaccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagcgcagctcagctgcactgcgttccgaggtgaagtcttgcccctgaattttgcaaaatgggaaagtgggcgcttgccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgta

SEQ ID NO: 1025 - DNA, 2044 bp, Homo sapiens
  ref <308>: DATABASE ACCESSION NUMBER: NM_004354
  ref <309>: DATABASE ENTRY DATE: 2001-06-18
ccggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacagggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttgtgttaaggcagaaataattaggctagggctcttagttttcattcctattgccccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatccgcattttcttatattaaaaaatgttctgcatgattacattttatttgcctttgt

SEQ ID NO: 1026 - DNA, 3090 bp, Homo sapiens
  ref <308>: DATABASE ACCESSION NUMBER: NM_004358
  ref <309>: DATABASE ENTRY DATE: 2001-06-18
agaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacacctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaaaaaaaaaaaaaaaaa

SEQ ID NO: 1027 - DNA, 4778 bp, Homo sapiens
  ref <308>: DATABASE ACCESSION NUMBER: NM_004360
  ref <309>: DATABASE ENTRY DATE: 2001-06-18
gcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgcctttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaattttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgtt

SEQ ID NO: 1028 - DNA, 2710 bp, Homo sapiens
  ref <308>: DATABASE ACCESSION NUMBER: NM_004362
  ref <309>: DATABASE ENTRY DATE: 2001-06-18
cgccggcgggactggtctgaagagacgcggggacaaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagaggatgtttggcattgtaaaaatcagcatgccagacctgaactttaatcagtctgcacatcctgtttctaatatctagcaacattatattctttcagacatttattttagtccttcatttccgaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaaaaaaaa

SEQ ID NO: 1029 - DNA, 422 bp, Homo sapiens
  ref <308>: DATABASE ACCESSION NUMBER: NM_004374
  ref <309>: DATABASE ENTRY DATE: 2001-06-18
gggggggggggggtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgccacatgaatatgtgggctaagaatagttcctcttgataaataaacaattaaca

SEQ ID NO: 1030 - DNA, 735 bp, Homo sapiens
  ref <308>: DATABASE ACCESSION NUMBER: NM_004378
  ref <309>: DATABASE ENTRY DATE: 2001-06-18
gagtctgcccttgcgagctcagagtgtgcccgtgcgccgccgccgtcgtacctgccgccgccgccaccgccaccatgcccaacttcgccggcacctggaagatgcgcagcagcgagaatttcgacgagctgctgaaggcactgggtgtgaacgccatgctgaggaaagtggccgtagcggctgcgtccaagccgcacgtggagatccgccaggacggggatcagttctacatcaagacatccaccaccgtgcgcaccactgagatcaacttcaaggtcggagaaggctttgaggaggagaccgtggacggacgcaagtgcaggagtttagccacttgggagaatgagaacaagatccactgcacccaaactcttcttgaaggggacggccccaaaacctactggacccgtgagctggccaacgatgaacttatcctgacgtttggcgccgatgacgtggtctgcaccagaatttatgtccgggaatgaaggcagctggcttgctcctactttcaggaagggatgcaggtccccgaggaatatgtcatagttctgagctgccagtggaccgcccttttcccctaccaatattaggtgatcccgttttccccatgacaatgttgtagtgtcccccacccccacccccctggccttggtgcctcttgtatccctagtgctgcatagcccggcatttgcacggtttcgaagtcattaaactggttagacgtgtctcaaa

SEQ ID NO: 1031 - DNA, 2510 bp, Homo sapiens
  ref <308>: DATABASE ACCESSION NUMBER: NM_004392
  ref <309>: DATABASE ENTRY DATE: 2001-06-18
gcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttccgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaaaaaaaaaaaaaaa

SEQ ID NO: 1032 - DNA, 2553 bp, Homo sapiens
  ref <308>: DATABASE ACCESSION NUMBER: NM_004395
  ref <309>: DATABASE ENTRY DATE: 2001-06-18
cgggaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctgccagacggcccgccgtgcctgcattcgcagcagctccgcctggcacccactccggattccggccctggctggggacttggccgcttccctacccacagggcctgacttttacagcttttctcttttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgg

SEQ ID NO: 1033 - DNA, 2173 bp, Homo sapiens
  ref <308>: DATABASE ACCESSION NUMBER: NM_004414
  ref <309>: DATABASE ENTRY DATE: 2001-06-18
gaactatagttgaaggctgctgccaatacaacaccactgtgaaacagaatggtgtatgccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatactttttttaactgcattctataataaatgggcacagtatgctccttacaaaaaaaaaaaaaaa

SEQ ID NO: 1034 - DNA, 1702 bp, Homo sapiens
  ref <308>: DATABASE ACCESSION NUMBER: NM_004418
  ref <309>: DATABASE ENTRY DATE: 2001-06-18
ggagtcgaccgctcgggcagcgcaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctccggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacacttcctcccccgcttcctcctagccctgtgggcaggggttggaaacttagcactttatatttatacagaacattcaggatttgtcaataaaatattgttatatttaaaaaaaaaaaaaaaaaaaaaaaaaaa

SEQ ID NO: 1035 - DNA, 1837 bp, Homo sapiens
  ref <308>: DATABASE ACCESSION NUMBER: NM_004425
  ref <309>: DATABASE ENTRY DATE: 2001-06-18
acaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggaaaaaaaaaaaaaaaaaa

SEQ ID NO: 1036 - DNA, 3921 bp, Homo sapiens
  ref <308>: DATABASE ACCESSION NUMBER: NM_004431
  ref <309>: DATABASE ENTRY DATE: 2001-06-18
cggaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtaacaactttgagctcaactttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccttccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccg

SEQ ID NO: 1037 - DNA, 749 bp, Homo sapiens
  ref <308>: DATABASE ACCESSION NUMBER: NM_004436
  ref <309>: DATABASE ENTRY DATE: 2001-06-18
cggtgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggaccccttgggctgagcaccaagaccttgaaccttttttgttttaccttttttccaaataacagttgggagaaatatcaatgaaattctgccg

SEQ ID NO: 1038 - DNA, 3107 bp, Homo sapiens
  ref <308>: DATABASE ACCESSION NUMBER: NM_004438
  ref <309>: DATABASE ENTRY DATE: 2001-06-18
aagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatg

SEQ ID NO: 1039 - DNA, 3805 bp, Homo sapiens
  ref <308>: DATABASE ACCESSION NUMBER: NM_004443
  ref <309>: DATABASE ENTRY DATE: 2001-06-18
ggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtgtccgggatgacctcctgtacaatgtcatctgcaagaagtgccatggggctggaggggcctcagcctgctcacgctgtgatgacaacgtggagtttgtgcctcggcagctgggcctgtcggagccccgggtccacaccagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgtcctgggggctgagggccctgtccccacccccgcccttggtgctgtcataaaagggcaggcaggggcaggctgaggagttgcccgttgccccccagagactgactctcagagccagagatgggatgtgtgagtgtgtgtgtgtgtgtgtgcgcgcgcgcgcgcgtgtgtgtgtgcacgcactggcctgcacagagagcatgggtgagcgtgtaaaagcttggccctgtgccctacagtggggacagctgggccgacagcagaataaaggcaataagatgaa

SEQ ID NO: 1040 - DNA, 4586 bp, Homo sapiens
  ref <308>: DATABASE ACCESSION NUMBER: NM_004446
  ref <309>: DATABASE ENTRY DATE: 2001-06-18
tatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcactcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagtttaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 1041 - DNA, 2402 bp, Homo sapiens
  ref <308>: DATABASE ACCESSION NUMBER: NM_004451
  ref <309>: DATABASE ENTRY DATE: 2001-06-18
agctcacagcaagtccaggctagaggtagaaacgtgagagccccacggctggggaagattgccatgggattggagatgagctccaaggacagccctggcagtctggatggaagagcttgggaagatgctcagaaaccacaaagtgcctggtgcggtgggaggaaaaccagagtgtatgctacaagcagccggcgggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgagccgaggctgtggagcagctgcgagaagctcctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgcacagcctgctggcagggccagggctaatgccatcagcccctgggaacaggccccacgccctctcctccccctcctagggggtgtcagaagctgggaacgtgtgtccaggctctgggcacagtgctgccccttgcaagccataacggtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 1042 - DNA, 4071 bp, Homo sapiens
  ref <308>: DATABASE ACCESSION NUMBER: NM_004454
  ref <309>: DATABASE ENTRY DATE: 2001-06-18
gagtccagccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctcgatcgatcatggactactaaatggcctttacatagaagggctctgatttgcacaatttgttgaaaaatcacaaacccatagaaaagtgagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaatgtgcactgtgtctttagccagggccgtgcaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttagctgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcaccctgcgcagggccgtatgcatcctgccaagctgcgttatattctgtactgtgtacaataaagaagtttgcttttcgttta

SEQ ID NO: 1043 - DNA, 2576 bp, Homo sapiens
  ref <308>: DATABASE ACCESSION NUMBER: NM_004456
  ref <309>: DATABASE ENTRY DATE: 2001-06-18
gaattccgggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaattttggaggccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgtttgttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgaaaaaaaaaaaaaaaaaa

SEQ ID NO: 1044 - DNA, 5043 bp, Homo sapiens
  ref <308>: DATABASE ACCESSION NUMBER: NM_004458
  ref <309>: DATABASE ENTRY DATE: 2001-06-18
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaagtttagcaaagcggggttataatgaatgacttccccaatatcttgcttgaacttacagtgattaacttggatgagttttgggaagttaaagggaagaaaacactgttatcattttttcctgtttgggaagagcttagaaactggaaatactagatttgggagaagggcagagttacttgataagggacttgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattccttccctggttgtttatcccttaggaatgagtttcttagactttcccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaaaaaaaaaaaaaaaaaaa

SEQ ID NO: 1045 - DNA, 2487 bp, Homo sapiens
  ref <308>: DATABASE ACCESSION NUMBER: NM_004472
  ref <309>: DATABASE ENTRY DATE: 2001-06-18
actcagccctggcctcgccgagctctgttcttagactctcacccgtcccgcacgttcctggtcgcctggcgttctgattcgcccgcccgggccccgccaccccctcctcagctgacggggcaaaagctgctccgagaggagaaggtcaagtcctccgcccgggccgggccgagcggagcccagggagcgcagcatccgcgcggctaccgcggcggcgcaggagttataaagtcggcgcgcgagactccgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcggtggcgggccccggctggctgtccccgcgcagcggcggcggcggcggcgctcgtacgccggggaggacgagctggaggatctggaggaggaggaggacgacgatgacatcctgctggccccgcctgctgggggctccccggcgcccccgggcccggccccggcggcgggggcaggagccggtgggggcggcggcggcggcggcgcgggcggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcggccgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaa

SEQ ID NO: 1046 - DNA, 3280 bp, Homo sapiens
  Modified_base 1 ... 3280: n = a,c,g, or t
  ref <308>: DATABASE ACCESSION NUMBER: NM_004480
  ref <309>: DATABASE ENTRY DATE: 2001-06-18
ggcncgacccgagcagccggttccctcctctccagnccccctcctcattncacccncgcngcctggcccagcgacccgtcccttcgtctccccgcggaatggggccggcactgctcagggtcgcgcgccctggacccagctcgctctcggtctcgcgctgtcaggactgcccggctcgcgccgcctcgcgctctgcctcagtcagtggcccgaacgtccgttaagcggcggcgcggttcctgtttccgtttcttcctctccgttcggtcgggagtagcatcctccactcagccacccttcccactcccccatcgtggggcagctgcggctgagggctgtggctttggcagctgcgacggggagcggcggagaccgtctgctcccgcctggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgcctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaaagtttctagaattttatatcattggatgatatgttgatcagccttatgtggaagaactgtgataaaaagaggagctttttagtttttcaaaaaaaa

SEQ ID NO: 1047 - DNA, 3874 bp, Homo sapiens
  ref <308>: DATABASE ACCESSION NUMBER: NM_004482
  ref <309>: DATABASE ENTRY DATE: 2001-06-18
atggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgtcttcggtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtattttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttattattttttatctatgtggaaaacacaataaaaaatcctcaacactattgtaatcatttggttaagtgcttattcctcttttgggtaaaatctgtaattgataataggtgggggaaaatgaattttgtatgctgaatttctaagcgcctattgtttgtaaaaccatcagatatttcttatggcacaaaaaatgaggaatagcaaaattcctgtgttcaatatttagaaaattttgtattaatttctgataaagttccttaagcatctgatagaatgatgttttaaaaaaatttgacgcttgcttaggagatttaccactttttttttttgtttttcgtcattttatatttagatctcctgtattcttgttcccgaagtaaaatacgatcggtttcatattttaaatctggcagagcctcagctgtacgaaaaagagcatatactggttattgaccctatcttctcattgtttgtttgtaagtttgaatttgtattaaaaagcctgcattctgagctggacatggtggctcagcttctaatcccagcactttggtaggcaaaggtgggaggatcatttgagctcaggagttccagaccagcctgggcaacatagcaaaatctcatctctacaaaaagtaaaaattaaaaaatgaaattaaaaataaaattacctaggtgtggtggcacgcatctgtagttccagctatacaggaaggtgaggcagaagcattgcttgagcttgggagatcgaggctacagtgagctatgattacaccactgcacttcagtctgtgtgactgagcaagactctttcaaaaaaaaaaaaaagcctacattctccagttgattatttccaactaatgtgtattatgtgcctaattttctatcagaagttgtattaagcccgttttcacactgctgttaaagacatacctgagactgggtaatttataaagaaaaataggttcaatggacccacaggtccgcgtggctggggaagcttcacaatcatggcggaaggtgaaagcatgtcttacgtggaag

SEQ ID NO: 1048 - DNA, 2376 bp, Homo sapiens
  ref <308>: DATABASE ACCESSION NUMBER: NM_004494
  ref <309>: DATABASE ENTRY DATE: 2001-06-18
gaggaggagtggggaccgggcggggggtggaggaagaggcctcgcgcagaggagggagcaattgaatttcaaacacaaacaactcgacgagcgcgcacccaccgcgccggagccttgccccgatccgcgcccgccccgtccgtgcggcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattact

SEQ ID NO: 1049 - DNA, 2872 bp, Homo sapiens
  ref <308>: DATABASE ACCESSION NUMBER: NM_004496
  ref <309>: DATABASE ENTRY DATE: 2001-06-18
tccaggaatcgatagtgcattcgtgcgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctcggtcccggtcagcaacatgaactcaggcctgggctccatgaactccatgaacacctacatgaccatgaacaccatgactacgagcggcaacatgaccccggcgtccttcaacatgtcctatgccaacccggccttaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgatgaatggcctgggcccctacgcggccgccatgaacccgtgcatgagccccatggcgtacgcgccgtccaacctgggccgcagccgcgcgggcggcggcggcgacgccaagacgttcaagcgcagttacccgcacgccaagccgccctactcgtacatctcgctcatcaccatggccatccagcgggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggccccgggcccggccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatccaacaactatttttatttcatttttcatgcacaaccttgcccccagtgcaaaagactgttactttattattgtattcaaaattcattgtgtatattactacaaagacggccccaaaccaatttttttcctgcgaagtttaatgatccacaagtgtatatatgaaattctcctccttccttgcccccctctctttcttccctcttggccctccagacattctagtttgtggagggttatttaaaaaacaaaaaggaagatggtcaagtttgtaaaatatttgtttgtgcttttcccccctccttacctgaccccctacgagtttacaggcttgtggcaatactcttaaccataagaattgaaatggtgaagaaacaagtatacactagaggctcttaaaagtattgaaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacgtgatacgttctcaagagttgcttgaccgaaagttacaaggaccccaacccctttgctctctacccacagatggccctgggaacaatcctcaggaattgccctcaagaactcgcttctttgctttgagagtgccatggtcatgtcattctgaggtacataacacataaattagtttctatgagtgtataccatttaaagattttttcagtaaagggaatattacatgttgggaggaggagataagttatagggagctggatttcaaacggtggtccaagattcaaaaatcctattgatagtggccattttaatcattgccatcgtgtgcttgtttcatccagtgttatgcactttccacagttggtgttagtatagccagagggtttcattattatttctctttgctttctcaatgttaatttattgcatggtttattctttttctttacagctgaaattgctttaaatgatggttaaaattacaaattaaattgggaatttttatcaatgtgattgtaattaaaaatattttgatttaaataacaaaaataataccagattttaagccgcggaaaatgttcttgatcatttgcagttaaggactttaaataaatcaaatgttaacaaaaaa

SEQ ID NO: 1050 - DNA, 1608 bp, Homo sapiens
  ref <308>: DATABASE ACCESSION NUMBER: NM_004503
  ref <309>: DATABASE ENTRY DATE: 2001-06-18
agaactagtctcgagtttttttttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttctccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggccggcctggcagccggggagggccggagcggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaa

SEQ ID NO: 1051 - DNA, 2584 bp, Homo sapiens
  ref <308>: DATABASE ACCESSION NUMBER: NM_004504
  ref <309>: DATABASE ENTRY DATE: 2001-06-18
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcgcaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggacgtacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaataaaaaaaaaaaaaaagaaaaaaaaaa

SEQ ID NO: 1052 - DNA, 1552 bp, Homo sapiens
  ref <308>: DATABASE ACCESSION NUMBER: NM_004515
  ref <309>: DATABASE ENTRY DATE: 2001-06-18
cggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaaagaaccacctcaaggagaggaagaagaaagcatggaaactcaggagtgacattcccttcactccttttcctacccaagggaaagactggagcctaagctgcctgctactggctttacatggtgacagacattccgtggataggaagatagcaggagaaagtaactccatagagtgtcattccactggttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtactt

SEQ ID NO: 1053 - DNA, 6927 bp, Homo sapiens
  ref <308>: DATABASE ACCESSION NUMBER: NM_004522
  ref <309>: DATABASE ENTRY DATE: 2001-06-18
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttatttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 1054 - DNA, 4908 bp, Homo sapiens
  ref <308>: DATABASE ACCESSION NUMBER: NM_004523
  ref <309>: DATABASE ENTRY DATE: 2001-06-18
acctgcgtgcagtcggtcctccaggccacgcagcgcccgagagtaccagggagactccggcccctgtcggcgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttaacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaacctatcctttcttattttcagtagtcagaattttatctagaaatcttttaacacctttttagtggttatttctaaaatcactgtcaacaataaatctaaccctagttgtatccctcctttaagtatttaaaacttgttgccccaaatgtgaaagcatttaattcctttaagaggcctaactcattcaccctgacagagttcacaaaaagcccactttagagtatacattgctattatgggagaccacccagacatctgactaatggctctgtgccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacatt

SEQ ID NO: 1055 - DNA, 14392 bp, Homo sapiens
  ref <308>: DATABASE ACCESSION NUMBER: NM_004525
  ref <309>: DATABASE ENTRY DATE: 2001-06-18
gcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccagctcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgatgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgttctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacggagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcgggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgcgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcggatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgggtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacatgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcaactgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctataggtggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgaaaaaaaa

SEQ ID NO: 1056 - DNA, 2067 bp, Homo sapiens
  ref <308>: DATABASE ACCESSION NUMBER: NM_004556
  ref <309>: DATABASE ENTRY DATE: 2001-06-18
ggaattccaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacggccttgggcggttcggctgcccacagtaaccgctgggtggacctggccagcgctccgaaccttgtcctcgctgcgcgccggcccctcggagccccacagcccgggaaggaggcggccgcgggcggggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccgcccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggagacacagcccttcatgtggcctgccagcgccagtcttggcctgtgcccgctgcctgctggaagggcgggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggctccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtccatcttcttgctgttgaggaccctgaaacaccgttgtttaaagacttcacacagaaggctctgaactgagccactggggaagggaagtttcagtaacatgacactaaaatggcagagacgttaaaaaaa

SEQ ID NO: 1057 - DNA, 1474 bp, Homo sapiens
  ref <308>: DATABASE ACCESSION NUMBER: NM_004559
  ref <309>: DATABASE ENTRY DATE: 2001-06-18
aaaaagaaatcaagaatgcaattttatttacaatagtcacgccggaaatacctagaaataaatttaactgaggatgtaaaagacctctacaaggagagttcaatgcgtagcgggagcggagagctgaccccagagagccctgggcagccccacctccgccgccggcctagttaccatcacaccccggagagcccgcagctgccgcagccggccccagtcaccatcaccgcaaccatgagcagcgaggccgagacccagcagccgcccgccgccccccccgccgcccccgccctcagcgccgccgacaccaagcccggcactaccggagcggcgcagggagcggtggcccgggcggctcacatcggcggcgctggcgcgggcgacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaagccaggcccaacaacgccggccctacgcaggcgaaggttcccaccttactacatgcggagacctatgggcgtcgaccacagtattccaaccctcctgtgcagggagaagtgatggagggtgctgacaaccagggtgcaggagaacaaggtagaccagtgaggcagatatgtatcggggatatagaccacgattccgcaggggccctcctcgccaaaagacagcctagagaggacggcaatgaagaagataaagaaaatcaaggagatgagacccaaggtcagcagccacctcaagctcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatgttttacctaaagacgtctctttttggtaataacaaaccgtgttttttaaaaaagcctggtttttctcaatacgcctttaaaggaattcc

SEQ ID NO: 1058 - DNA, 1394 bp, Homo sapiens
  ref <308>: DATABASE ACCESSION NUMBER: NM_004569
  ref <309>: DATABASE ENTRY DATE: 2001-06-18
gaccagggcgggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatatt

SEQ ID NO: 1059 - DNA, 1600 bp, Homo sapiens
  ref <308>: DATABASE ACCESSION NUMBER: NM_004577
  ref <309>: DATABASE ENTRY DATE: 2001-06-18
gtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccaaggatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaaaaaaaaaaaaaaaaaaaaaaaaaa

SEQ ID NO: 1060 - DNA, 768 bp, Homo sapiens
  ref <308>: DATABASE ACCESSION NUMBER: NM_004585
  ref <309>: DATABASE ENTRY DATE: 2001-06-18
ccttcagcataaaagctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggggcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcgcccagctgagatatggcaagtcccgctgtaaacaggtggaaaaggccaaggttgaagtcggtgtggccacggcgcttggaatcctggttgttgctggatgctcttttgcgattaggagataccaaaaaaaagcaacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcaaaaaaaaaaa

SEQ ID NO: 1061 - DNA, 3106 bp, Homo sapiens
  ref <308>: DATABASE ACCESSION NUMBER: NM_004587
  ref <309>: DATABASE ENTRY DATE: 2001-06-18
ggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaagggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcagagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcatggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacaaaaaaaaaaaaaaaaaaaa

SEQ ID NO: 1062 - DNA, 3761 bp, Homo sapiens
  ref <308>: DATABASE ACCESSION NUMBER: NM_004594
  ref <309>: DATABASE ENTRY DATE: 2001-06-18
gtggcggacgggcggacgcgggccggcggccgctgcggtgccgggagggcggctgggcaggcggcaggaatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagcttccctgccccaatcctccccagcatggtcatgttcgtggtgtcctggcagtgaagctccgtgagggggctggcccttagaggaactggggtgggaagtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctaaacctttctgatccttgggtctgggttttttgaggaagggacatagtggcctctgggctgccatgtcaccacctgcaacattccccaaacagataagaacccatcatctcagggccactgctccattgctctgggggctgggattcctggctaagcaggggctgacagggtggcaggtgactttctagggatcagcacctgccctgtgttttgtaccttgaacctaagatatattaaacatctctcagatggaaaaaaaaaaaaaaaaaaaa

SEQ ID NO: 1063 - DNA, 4249 bp, Homo sapiens
  ref <308>: DATABASE ACCESSION NUMBER: NM_004599
  ref <309>: DATABASE ENTRY DATE: 2001-06-18
ccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccgccaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtgggggcacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggaggcagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatctta

SEQ ID NO: 1064 - DNA, 2088 bp, Homo sapiens
  ref <308>: DATABASE ACCESSION NUMBER: NM_004603
  ref <309>: DATABASE ENTRY DATE: 2001-06-18
catgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacgcttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtgaccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgtaaaaaaaaaaaaaaaaaagcgttc

SEQ ID NO: 1065 - DNA, 1104 bp, Homo sapiens
  ref <308>: DATABASE ACCESSION NUMBER: NM_004616
  ref <309>: DATABASE ENTRY DATE: 2001-06-18
ctctagagtcgagatccattgtgctctaaagtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttaaaaaaaaaaaaaaaaaaaaa

SEQ ID NO: 1066 - DNA, 1286 bp, Homo sapiens
  ref <308>: DATABASE ACCESSION NUMBER: NM_004633
  ref <309>: DATABASE ENTRY DATE: 2001-06-18
gccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacac

SEQ ID NO: 1067 - DNA, 1608 bp, Homo sapiens
  ref <308>: DATABASE ACCESSION NUMBER: NM_004642
  ref <309>: DATABASE ENTRY DATE: 2001-06-18
gcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgt

SEQ ID NO: 1068 - DNA, 2433 bp, Homo sapiens
  ref <308>: DATABASE ACCESSION NUMBER: NM_004648
  ref <309>: DATABASE ENTRY DATE: 2001-06-18
cagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtatcagttgcagctggagagtcggccattctgcactgcactgtgacctccctgatccctgtggggcccatccagtggttcagaggagctggaccagcccgggaattaatctacaatcaaaaagaaggccacttcccccgggtaacaactgtttcagagtccacaaagagagaaaacatggacttttccatcagcatcagtaacatcaccccagcagatgccggcacctactactgtgtgaagttccggaaagggagccctgacacggagtttaagtctggagcaggcactgagctgtctgtgcgtgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctcccccaacattgccacacacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggcaaagagccatgagtcctggaggaggagaggacccctcccaaaggactggaagcaaaaccctctgcttccttgggtccctccaagactccctggggcccaactgtgttgctccacccggacccatctctcccttctagacctgagcttgcccctccagctagcactaagcaacatctcgctgtaagcgcctgtaaattactgtgaaatgtgaaacgtgcaatcttgaaactgaggtgttagaaaacttgatctgtggtgttttgttttgttttttttcttaaaacaacagcaacgtgaaaaaaaaaaaaaaaaa

SEQ ID NO: 1069 - DNA, 2333 bp, Homo sapiens
  ref <308>: DATABASE ACCESSION NUMBER: NM_004663
  ref <309>: DATABASE ENTRY DATE: 2001-06-18
acgagcagcgacgcccctggtcccacagataccactgcctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttctcccgaatgactgcagctttttttcatgctatggcttcactagccttagtttaataaactgaatgtttggattcctcagttattgtttacttttcatcatggaagcctgtcactgtatgtaggacataatagaacttatcacttgaagctcagcctattggtcttgatcaaatcaaactaagaagaccttagaaataagctaccattttgccacagagcagcttataggtaatacactcttctctcagtgcagtgtacatttccacaaatctaagaattgccctataaacatagcagggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttaggaccttccagtaagtgaaatacaacctagttttatcaccatatccaccagcaggcatccataattattttaacaatgctaatatttgagttttgcagtatattatagaataatatagtccagttaaatctttggtttcagtatgtctgaagagtacagtgagaggttaattttctgctcaagtggtaccacttaaaggcatgtattcttttagtatgtaaaatgaaatagtaccttgagtttaaatagaatgcatttaggcattgtagagatctgaaatagttttcttccactgcgttgttgaaatcaatgaagcaattagtttctcattcagaaatgtgcacactaatatttagttttgctttctcgtggataatattaagcacttactctgcagtttctggaagttgtgtcaactgcagtgatactattcaggatggtgggaaatccccaaaaatatgtatcttttggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggatt

SEQ ID NO: 1070 - DNA, 1176 bp, Homo sapiens
  ref <308>: DATABASE ACCESSION NUMBER: NM_004664
  ref <309>: DATABASE ENTRY DATE: 2001-06-18
gccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttt

SEQ ID NO: 1071 - DNA, 2645 bp, Homo sapiens
  ref <308>: DATABASE ACCESSION NUMBER: NM_004684
  ref <309>: DATABASE ENTRY DATE: 2001-06-18
gagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgagtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtgacttaagtgtgaatttggagtatgcaccatctgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaaaaaaaaaaaaaaa

SEQ ID NO: 1072 - DNA, 1426 bp, Homo sapiens
  ref <308>: DATABASE ACCESSION NUMBER: NM_004688
  ref <309>: DATABASE ENTRY DATE: 2001-06-18
ggatccgcgtgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctccgggggttcgcgtttcaggcgctcgtgttttccgggaagggcaggcgcgctgggccttggggagctgcgctcggcgggcggaccgggggatcatggaagctgataaagatgacacacaacaaattcttaaggagcattcgccagatgaatttataaaagatgaacaaaataagggactaattgatgaaattacaaagaaaaatattcagctaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcgtttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacactgcgtgaagatcaaatgagagacaaactagagctgagcttttcaaagttccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaagaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttat

SEQ ID NO: 1073 - DNA, 2211 bp, Homo sapiens
  ref <308>: DATABASE ACCESSION NUMBER: NM_004694
  ref <309>: DATABASE ENTRY DATE: 2001-06-18
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatcattatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaagatgatgtcgtgggcattgcagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcgtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtc

SEQ ID NO: 1074 - DNA, 1719 bp, Homo sapiens
  ref <308>: DATABASE ACCESSION NUMBER: NM_004695
  ref <309>: DATABASE ENTRY DATE: 2001-06-18
ccgaattcgggggcagcagccacattggcagtgaggccgtggcagcgtcagcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgttaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaaaaaaaaaaaaaa

SEQ ID NO: 1075 - DNA, 1530 bp, Homo sapiens
  ref <308>: DATABASE ACCESSION NUMBER: NM_004701
  ref <309>: DATABASE ENTRY DATE: 2001-06-18
aatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtgggccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggtaaaaaaaaaaaaaaaaaa

SEQ ID NO: 1076 - DNA, 2648 bp, Homo sapiens
  ref <308>: DATABASE ACCESSION NUMBER: NM_004702
  ref <309>: DATABASE ENTRY DATE: 2001-06-18
ggcacagggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaaaaa

SEQ ID NO: 1077 - DNA, 559 bp, Homo sapiens
  ref <308>: DATABASE ACCESSION NUMBER: NM_004708
  ref <309>: DATABASE ENTRY DATE: 2001-06-18
ctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaaaaaaaaaaaaaaaaaaaaaaaaaaaaaaaaaaaaaaa

SEQ ID NO: 1078 - DNA, 4366 bp, Homo sapiens
  ref <308>: DATABASE ACCESSION NUMBER: NM_004711
  ref <309>: DATABASE ENTRY DATE: 2001-06-18
atggaagggggtgcgtacggagcgggcaaagccgggggcgccttcgacccgtacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcgggccaggctgtgctggccttccagcggtaccagattggcgccgactcggccctcttctcccaggactacatggaccccagccaggactccagcatgccttacgcgccctacgtggagcccaacactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcgtacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcaggcccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacaggcccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcctccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaaccca

SEQ ID NO: 1079 - DNA, 2285 bp, Homo sapiens
  ref <308>: DATABASE ACCESSION NUMBER: NM_004726
  ref <309>: DATABASE ENTRY DATE: 2001-06-18
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggatagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacagcaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccata

SEQ ID NO: 1080 - DNA, 2502 bp, Homo sapiens
  ref <308>: DATABASE ACCESSION NUMBER: NM_004741
  ref <309>: DATABASE ENTRY DATE: 2001-06-18
gaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaagtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagagatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaagccccagtgaaagcagctaccacccctacccggaagagttctagcagtgaggattcctccagtgacgaggaagaggagcaaaaaaaacccatgaaaaataaaccaggtccctacagttacgcccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagcgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgaaaaaaaaaaaggaattc

SEQ ID NO: 1081 - DNA, 1716 bp, Homo sapiens
  ref <308>: DATABASE ACCESSION NUMBER: NM_004750
  ref <309>: DATABASE ENTRY DATE: 2001-06-18
cgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggagtgagtggagccaccccacagccgcctccactccccgcagtgagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgc

SEQ ID NO: 1082 - DNA, 2334 bp, Homo sapiens
  ref <308>: DATABASE ACCESSION NUMBER: NM_004761
  ref <309>: DATABASE ENTRY DATE: 2001-06-18
atgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctga

SEQ ID NO: 1083 - DNA, 3311 bp, Homo sapiens
  ref <308>: DATABASE ACCESSION NUMBER: NM_004762
  ref <309>: DATABASE ENTRY DATE: 2001-06-18
gcgagcgggggcgcgggtggcgcggcgggacgcgagcggcgagccggagcgcgagcccgctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctattttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtcttggcgagatggacaggtgaggtcgaggacgcagagggcagaggcccagtggagcctcagacggcacagtcagagtcgggggcctgcctggccggggtcgcagtcggcagcagcgtgcagtccggcatctcccgcggatgcttttccatcccaagtgcctgcggagcccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagcttcagctttttctgcctcaaaaccagccctaactggactactctggatgcattttgtggtgggccccctagagggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcaaaaaaaaaa

SEQ ID NO: 1084 - DNA, 2036 bp, Homo sapiens
  ref <308>: DATABASE ACCESSION NUMBER: NM_004772
  ref <309>: DATABASE ENTRY DATE: 2001-06-18
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtccccccccccacctttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctg

SEQ ID NO: 1085 - DNA, 1174 bp, Homo sapiens
  ref <308>: DATABASE ACCESSION NUMBER: NM_004780
  ref <309>: DATABASE ENTRY DATE: 2001-06-18
gcctgtccaccatctccctattaccctttggtcgagagggaaagcagaagaagtctgctggtcacacgggggcacctcgaggagaggacgactaggagcacacggcccggaaaggtccaggtcagggaagggaataactgtgcttgaagaagaaaattcccaacatggacaaaccacgcaaagaaaatgaagaagagccgcagagccgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggactccctccgcaggtctttccaggaaggacctgtttgaggttcgccctcccatggagcagcctccttgtggagtaggaaaacataaccttgaagaaggaatctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggagggcaaaacggggcggtccttatcctatttaatgtgttcggcctttaattctgttttgcctgctatagtattgccattgccacctggactttctgtttgcattttcttaatgccttttccctatttctgaattttaactttttgtgaggctttattttagatgtttagcatgtaactcgcttaaagttgaggtttccccctaaaatctacaagtttccctctttcagtcatgagccctacacatttgcatgaaagatgtacatatatattgtgaacgaaaaaagcaattttcaaatggtatatatgtatcccattttgtaaaaaatgtatattatatattaatatgcaaagaaaaagctaaaagtatagacttcaaaggcataacagtggttgtgtggtaagatataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagg

SEQ ID NO: 1086 - DNA, 2498 bp, Homo sapiens
  ref <308>: DATABASE ACCESSION NUMBER: NM_004791
  ref <309>: DATABASE ENTRY DATE: 2001-06-18
accagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcagactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtgtactctcactttaaactcaccaaagaagattctcttaaagaaattatgaaaaatgtacaatttaacattttaaataaatagtgacagaagttgtttaaaaa

SEQ ID NO: 1087 - DNA, 4724 bp, Homo sapiens
  ref <308>: DATABASE ACCESSION NUMBER: NM_004798
  ref <309>: DATABASE ENTRY DATE: 2001-06-18
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatacagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcgaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctggcactttgggaggccgaggtgggtggaccacctgaggttaggacttcgagaccagcctggccaacatggtggaaccccgtctgtactaaaagtgcaaaggtttgcctggtgtggtggtgcatgcctctagtcctggctactcgggaggctgaggcacgagaatcgcttgggcctgggaggcggaggttgcagtgagtcgagataacactactgcattccagcctgggtgacagagtgagactccacctc

SEQ ID NO: 1088 - DNA, 2838 bp, Homo sapiens
  ref <308>: DATABASE ACCESSION NUMBER: NM_004808
  ref <309>: DATABASE ENTRY DATE: 2001-06-18
ctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaaagaaagagcctgtacccgcgactaactagacttttcttgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgccg

SEQ ID NO: 1089 - DNA, 1875 bp, Homo sapiens
  ref <308>: DATABASE ACCESSION NUMBER: NM_004811
  ref <309>: DATABASE ENTRY DATE: 2001-06-18
aaagcatccagttcctttgcggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttgccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaaaaaaaaaaaaaaaaaaaaaaaaaaaaaaaaaa

SEQ ID NO: 1090 - DNA, 1485 bp, Homo sapiens
  ref <308>: DATABASE ACCESSION NUMBER: NM_004833
  ref <309>: DATABASE ENTRY DATE: 2001-06-18
tcagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgtaaggaaggagataaggttcgacttacattcttcacactgtcaaaaaatggagaaaaactacagctgacatctggagttcatagcaccataaaggttattaaggccaaaaaaaaaacatagagaagtaaaaaggaccaattcaagccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattcc

SEQ ID NO: 1091 - DNA, 2321 bp, Homo sapiens
  ref <308>: DATABASE ACCESSION NUMBER: NM_004835
  ref <309>: DATABASE ENTRY DATE: 2001-06-18
attcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcggatgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgc

SEQ ID NO: 1092 - DNA, 2663 bp, Homo sapiens
  ref <308>: DATABASE ACCESSION NUMBER: NM_004843
  ref <309>: DATABASE ENTRY DATE: 2001-06-18
acgaggcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccagggaatttcactgtcggggtcccctatcgaatcactgtgaccgcagtctctgcttcaggcttggcctctgcatcctccgtctgggggttcagggaggaattagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatgtgagtggcaacacacagagtgtcaccctgcctgaccttccttggggtccctgtgagctgtgggtgacagcatctaccatcgctggacagggccctcctggtcccatcctccggcttcatctaccagataacaccctgaggtggaaagttctgccaggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagca

SEQ ID NO: 1093 - DNA, 1363 bp, Homo sapiens
  ref <308>: DATABASE ACCESSION NUMBER: NM_004847
  ref <309>: DATABASE ENTRY DATE: 2001-06-18
gaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcactcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 1094 - DNA, 2366 bp, Homo sapiens
  ref <308>: DATABASE ACCESSION NUMBER: NM_004848
  ref <309>: DATABASE ENTRY DATE: 2001-06-18
gaccacgcgtatcgatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaagatgaggaggaagagtgcaaagaggaggcagagacccagagcgggtcctgctgcccttccacttccctggcagtttcgtggaggagatgagtgacagccggcgctacagcctggcagatctgactgcccagttttcaatgccttgtgaggtcaaggtggtggccaaggacaccagccaccccaatgaccctcagaacctccttcctgggcctgcggctggaggagaagatcacagagccattcttggtggtgagcctggactctgagctgggatgtgctttgagatccctccccggaggctggacctgactgtcgtggaggccaaggggcagccagacttgccagaggggtctctccccatagccacagtggaggaagctggaacagacaccttttattattgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgttcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcc

SEQ ID NO: 1095 - DNA, 1204 bp, Homo sapiens
  ref <308>: DATABASE ACCESSION NUMBER: NM_004864
  ref <309>: DATABASE ENTRY DATE: 2001-06-18
cggaacgagggcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaagcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggacgactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggagccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggaggcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttaaaaaaaaaaa

SEQ ID NO: 1096 - DNA, 1283 bp, Homo sapiens
  ref <308>: DATABASE ACCESSION NUMBER: NM_004865
  ref <309>: DATABASE ENTRY DATE: 2001-06-18
ggccgcctcgcacccggaacaacaaagcaaggaagacggagcgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggattggactcaaaaggaaaactggaccaacaaaagataaaaaaaaaaaaaaaaaaaaa

SEQ ID NO: 1097 - DNA, 1926 bp, Homo sapiens
  ref <308>: DATABASE ACCESSION NUMBER: NM_004866
  ref <309>: DATABASE ENTRY DATE: 2001-06-18
ggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaagaagaactagaaagaaaagccgcagaattagatcgtcgggaacgagaaatgcaaaacctcagtcaacatggtagaaaaaatatttggccacctcttcctagcaattttcctgtcggaccttgtttctatcaggaattttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattccttttt

SEQ ID NO: 1098 - DNA, 561 bp, Homo sapiens
  ref <308>: DATABASE ACCESSION NUMBER: NM_004877
  ref <309>: DATABASE ENTRY DATE: 2001-06-18
aatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaggtgactggggacttggaaccctaggacctgaacaaccaagactttaaataattttaaatgcaaaaactcagaaaaaaaaaaaaaaa

SEQ ID NO: 1099 - DNA, 1008 bp, Homo sapiens
  ref <308>: DATABASE ACCESSION NUMBER: NM_004900
  ref <309>: DATABASE ENTRY DATE: 2001-06-18
gcaattctagccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggctggatggtcctgatggaccagcacatgggctttctatgcaacgaggctaagaatcttctctgtggcttttacggccgccatgcggactggcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgccgatcttcgctgcccgcatctatgattatgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacgagccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacactaaaaaaaaaaaaaaaaaaaaaaa

SEQ ID NO: 1100 - DNA, 1622 bp, Homo sapiens
  ref <308>: DATABASE ACCESSION NUMBER: NM_004906
  ref <309>: DATABASE ENTRY DATE: 2001-06-18
ggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgcctt

SEQ ID NO: 1101 - DNA, 4211 bp, Homo sapiens
  ref <308>: DATABASE ACCESSION NUMBER: NM_004910
  ref <309>: DATABASE ENTRY DATE: 2001-06-18
cgcgggcggcggtgctaggctcgcctctgcctccctcgtggcgggcccggacatggggtcccgtggcctgagtccctcggccggcgcgcagggctcggggccgcgcgcaccttccccgcactgactgtcgcgccgtgccctgcgccaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggccgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctccagagcctggttcaggaggtaggactgaacatcgtggccggttatgggtctcccaaagatgtggctgtatacacggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcaccccaaaaaaaaaaaaaaaaaaaaaaa

SEQ ID NO: 1102 - DNA, 2864 bp, Homo sapiens
  ref <308>: DATABASE ACCESSION NUMBER: NM_004911
  ref <309>: DATABASE ENTRY DATE: 2001-06-18
ccagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccaccggaggccggcaacaaacgacagtatctcggattcctttttttttttttttaattttttatactttgttgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttaaaaaaaaaaaaaaaaaaaaaaaaaaaaaaaaaaaaagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagctgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctt

SEQ ID NO: 1103 - DNA, 1152 bp, Homo sapiens
  ref <308>: DATABASE ACCESSION NUMBER: NM_004918
  ref <309>: DATABASE ENTRY DATE: 2001-06-18
gaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagatatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccggagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtcaaaaaaaaaaaaaaaaaaaaaaaaa

SEQ ID NO: 1104 - DNA, 2134 bp, Homo sapiens
  ref <308>: DATABASE ACCESSION NUMBER: NM_004923
  ref <309>: DATABASE ENTRY DATE: 2001-06-18
aattcggggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccgcgggtgttttgcccctggggcgcctgggtcctgcgaaggagcctcccacccgggcgtccgcatgatcccagttgaaatcaaggtaagcaggtggtactactacaagtaataatccggaagaagcaactttgcagaatcttcttgctcaggaatcctgttgcaagttcccatggtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagagacacgcgaactgtcagtctttctaaggccccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcgaaaaaaaaaaaaaaaaaaaaaaaaa

SEQ ID NO: 1105 - DNA, 5910 bp, Homo sapiens
  ref <308>: DATABASE ACCESSION NUMBER: NM_004938
  ref <309>: DATABASE ENTRY DATE: 2001-06-18
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcaagttacttgtgcagcttcggctcaaatcccaatatccaggacaaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaacccagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgtggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccaataacggggctcccaaggatttcctccccagccccctccacgccctgctgcgggaatggaccacctaccctgagagcacagtgggcaccctcatgtccaaactgagggagctgggtcgccgggatgccgcagaccttttgctgaaggcatcctctgtgttcaaaatcaacctggatggcaatggccaggaggcctatgcctcgagctgcaacagcggcacctcttacaattccattagctctgttgtatcccggtgagggcagcctctggcttggacagggtctgtttggactgcagaaccaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactatcatattgattgtcctttaaaaaagaaaagtgcatatttatccaaaatgtgtatttcttatacgcttttctgtgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttaaaaaaaaaaaaaa

SEQ ID NO: 1106 - DNA, 1643 bp, Homo sapiens
  ref <308>: DATABASE ACCESSION NUMBER: NM_004951
  ref <309>: DATABASE ENTRY DATE: 2001-06-18
ggaattccctgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccacggctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcgctttcccatctccaactcggaagtaagcccaagagaacaacataaagcaaacaacataaagcacaataaaaatgcaaataaatattttcatttttatttgtaaacgaatacaccaaaaggaggcgctcttaataactcccaatgtaaaaagttttgttttaataaaaaattaattattattcttgccaacaaatggctagaaaggactgaatagattatatattgccagatgttaatactgtaacatactttttaaataacatatttcttaaatccaaatttctctcaatgttagatttaattccctcaataacaccaatgttttgttttgtttcgttctgggtcataaaactttgttaaggaactcttttggaataaagagcaggatgctgcggaattc

SEQ ID NO: 1107 - DNA, 1427 bp, Homo sapiens
  ref <308>: DATABASE ACCESSION NUMBER: NM_004968
  ref <309>: DATABASE ENTRY DATE: 2001-06-18
attaacccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataaaaaaaaaaaa

SEQ ID NO: 1108 - DNA, 2334 bp, Homo sapiens
  ref <308>: DATABASE ACCESSION NUMBER: NM_004994
  ref <309>: DATABASE ENTRY DATE: 2001-06-18
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttgcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttt

SEQ ID NO: 1109 - DNA, 5212 bp, Homo sapiens
  ref <308>: DATABASE ACCESSION NUMBER: NM_004999
  ref <309>: DATABASE ENTRY DATE: 2001-06-18
cttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacactagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagt

SEQ ID NO: 1110 - DNA, 531 bp, Homo sapiens
  ref <308>: DATABASE ACCESSION NUMBER: NM_005001
  ref <309>: DATABASE ENTRY DATE: 2001-06-18
ggcccttcagtatgcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaaaaaaaaaaaaaaaaaaa

SEQ ID NO: 1111 - DNA, 1134 bp, Homo sapiens
  ref <308>: DATABASE ACCESSION NUMBER: NM_005002
  ref <309>: DATABASE ENTRY DATE: 2001-06-18
atggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttag

SEQ ID NO: 1112 - DNA, 3358 bp, Homo sapiens
  ref <308>: DATABASE ACCESSION NUMBER: NM_005012
  ref <309>: DATABASE ENTRY DATE: 2001-06-18
gagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgacccttgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcttgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtggagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggatggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 1113 - DNA, 3089 bp, Homo sapiens
  ref <308>: DATABASE ACCESSION NUMBER: NM_005032
  ref <309>: DATABASE ENTRY DATE: 2001-06-18
aaagattccgaggtgcagaagttgtctgagtgggttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttcccaggtgaagtgcttatggcttaaggaactcttggccattcaaaggacttttcattttgattaacaggactagcttatcatgagagcctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagtacagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataat

SEQ ID NO: 1114 - DNA, 6034 bp, Homo sapiens
  ref <308>: DATABASE ACCESSION NUMBER: NM_005044
  ref <309>: DATABASE ENTRY DATE: 2001-06-18
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcctgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagttcttcttaccgggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagttaggtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagactgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtcgtcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagctcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctgtaattctttggaccattgtaactgtgaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttgctctcgtttttccttcaagctacctagcatgcattttacacacattggaggagtcgtatgcactgtttttctgttgctgatggaggcaagcaggccttctaattagtctaagttaaacggatgggattcacttaagaaaagcaagaagaaaagcacacgaacaggtgtcttaatgcatttggatagtttctttgcggggtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggtttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgctggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttatttaataaaactttgtatcttttcagaaaaaaaaaaaaa

SEQ ID NO: 1115 - DNA, 969 bp, Homo sapiens
  ref <308>: DATABASE ACCESSION NUMBER: NM_005046
  ref <309>: DATABASE ENTRY DATE: 2001-06-18
ggatttccgggctccatggcaagatcccttctcctgcccctgcagatcctactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccctcaa

SEQ ID NO: 1116 - DNA, 3201 bp, Homo sapiens
  ref <308>: DATABASE ACCESSION NUMBER: NM_005049
  ref <309>: DATABASE ENTRY DATE: 2001-06-18
ggatccgcgcggcacacgtgcgacggccgtgatgaagttcgcttaccggttttcaaatttgctgggtacggtgtaccggcgtgggaacctaaattttacctgcaatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaataccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcgggcaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcgggcccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 1117 - DNA, 975 bp, Homo sapiens
  ref <308>: DATABASE ACCESSION NUMBER: NM_005067
  ref <309>: DATABASE ENTRY DATE: 2001-06-18
atgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatga

SEQ ID NO: 1118 - DNA, 2352 bp, Homo sapiens
  ref <308>: DATABASE ACCESSION NUMBER: NM_005077
  ref <309>: DATABASE ENTRY DATE: 2001-06-18
acagagccccgccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgcccgcggccgccgtggtcggtacgggcgctcccccatggtggggtttgatcctccccctcacatgagagtacctaccattcctccaaacctggcaggaatccctggggggaaacctgcatactccttccacgttactgcagacggtcagatgcagcctgtcccttttcccccgacgcccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggt

SEQ ID NO: 1119 - DNA, 1836 bp, Homo sapiens
  ref <308>: DATABASE ACCESSION NUMBER: NM_005080
  ref <309>: DATABASE ENTRY DATE: 2001-06-18
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcaaaaaaaaaaaaaaaaa

SEQ ID NO: 1120 - DNA, 1505 bp, Homo sapiens
  ref <308>: DATABASE ACCESSION NUMBER: NM_005084
  ref <309>: DATABASE ENTRY DATE: 2001-06-18
gctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggtttttt

SEQ ID NO: 1121 - DNA, 7288 bp, Homo sapiens
  ref <308>: DATABASE ACCESSION NUMBER: NM_005128
  ref <309>: DATABASE ENTRY DATE: 2001-06-18
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgcgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacccctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggcgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggggctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcagattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttggg

SEQ ID NO: 1122 - DNA, 1163 bp, Homo sapiens
  ref <308>: DATABASE ACCESSION NUMBER: NM_005130
  ref <309>: DATABASE ENTRY DATE: 2001-06-18
ctctacctgacacagctgcagcctgcaattcactcccactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaagggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcctttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcaaaaaaaaaaaaaaaaa

SEQ ID NO: 1123 - DNA, 1339 bp, Homo sapiens
  ref <308>: DATABASE ACCESSION NUMBER: NM_005139
  ref <309>: DATABASE ENTRY DATE: 2001-06-18
gaattccgattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagataataaaacggaattc

SEQ ID NO: 1124 - DNA, 1381 bp, Homo sapiens
  ref <308>: DATABASE ACCESSION NUMBER: NM_005148
  ref <309>: DATABASE ENTRY DATE: 2001-06-18
cagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgatcccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttcaaaaaaaaaaaaaa

SEQ ID NO: 1125 - DNA, 735 bp, Homo sapiens
  ref <308>: DATABASE ACCESSION NUMBER: NM_005168
  ref <309>: DATABASE ENTRY DATE: 2001-06-18
atgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtga

SEQ ID NO: 1126 - DNA, 1508 bp, Homo sapiens
  ref <308>: DATABASE ACCESSION NUMBER: NM_005190
  ref <309>: DATABASE ENTRY DATE: 2001-06-18
gagcgcggttaccggacgggctgggtctatggtcgctccgcggccgctccgccgcgtggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaatagtttttctttaatatgattctagtacataattgattgattaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtaccgtatattgatttaaaagtgtattttattcagtagtttgagg

SEQ ID NO: 1127 - DNA, 10096 bp, Homo sapiens
  ref <308>: DATABASE ACCESSION NUMBER: NM_005196
  ref <309>: DATABASE ENTRY DATE: 2001-06-18
ggagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagaactcttcagaaaattcaagagcttgaaggacagcttgacaaactgaagaaggaaaagcagcaaaggcagtttcagcttgacagtctcgaggctgcgccgcagaagcaaacacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaactagaggtgactccaagtcgatcaactttgcaaatagggaaaagagatgctaatagcagtttctttggcaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctttaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggttgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatat

SEQ ID NO: 1128 - DNA, 439 bp, Homo sapiens
  ref <308>: DATABASE ACCESSION NUMBER: NM_005213
  ref <309>: DATABASE ENTRY DATE: 2001-06-18
actttggttccagcatcctgtccagcaaagaagcaatcagccaaaatgatacctggaggcttatctgaggccaaacccgccactccagaaatccaggagattgttgataaggttaaaccacagcttgaagaaaaaacaaatgagacttatggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttcca

SEQ ID NO: 1129 - DNA, 366 bp, Homo sapiens
  ref <308>: DATABASE ACCESSION NUMBER: NM_005218
  ref <309>: DATABASE ENTRY DATE: 2001-06-18
gtcagctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtat

SEQ ID NO: 1130 - DNA, 5484 bp, Homo sapiens
  ref <308>: DATABASE ACCESSION NUMBER: NM_005235
  ref <309>: DATABASE ENTRY DATE: 2001-06-18
aattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttctttttttttttttttttaaagcagatggttgaaacacccatgctatctgttcctatctgcaggaactgatgtgtgcatatttagcatccctggaaatcataataaagtttccattagaacaaaagaataacattttctataacatatgatagtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctc

SEQ ID NO: 1131 - DNA, 14756 bp, Homo sapiens
  ref <308>: DATABASE ACCESSION NUMBER: NM_005245
  ref <309>: DATABASE ENTRY DATE: 2001-06-18
ctgggcggccgggcgcggggagagggcgcgggagcggctcgtgcggcaggtaccatgcggacgcgcgagcccggcgaggccccggcaggcccgtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtcgtcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaat

SEQ ID NO: 1132 - DNA, 2559 bp, Homo sapiens
  ref <308>: DATABASE ACCESSION NUMBER: NM_005249
  ref <309>: DATABASE ENTRY DATE: 2001-06-18
tttttttttaattcctgaggggtggttgctgcttttgctacatgacttgccagcgcccgagcctgcgtccaactgcgctgctgccggagcgctcagtgccgccgctgccgcccgccgcccccccgcgccccgttcggcacccaccggtcgccgcgccgcccgcgcgccgctgtcccgctcccgcgccgccgccgccgtttccccccgacgactgggtgatgctggacatgggagataggaaagaggtgaaaatgatccccaagtcctcgttcagcatcaacagcctggtgcccgagggcctccagaacgacaaccaccacgcgagccacggccaccacaacagccaccacccccagcaccaccaccaccaccaccaccatcaccaccacccgccgccgcccgccccgcaaccgccgccgccccgagccgcgcagcagcagcagccgccgccgccgccgctcgccccgcaggccggcggcgccgcgcaatcgaacgacgaaaagggcccccagctgcttctgctcccgccgaccgaccaccaccggccgccgtccggagctaaagccggaggctgctgccggcctggggagctggggcccgtcgggccggacgagaaggagaagggcgccggcgctgggggggaggagaagaagggcgcgggcgagggcggcaaggacggggaggggggcaaggagggcgagaagaagaacggcaagtacgagaagccgccgttcagctacaacgcgctcatcatgatggccatccggcagagccccgagaagcgcctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgccggccaagctggccttcaagcgcggtgccgcgctcacctccaccggcctcaccttcatggaccgcgccggctccctctactggcccatgtcgcccttcctgtccctgcaccaccctcgcgccagcagcactttgagttacaacgggaccacgtcggcctaccccagccaccccatgccctacagctccgtgttgactcaaaactcgctgggcaacaaccactccttctccaccgccaacgggctgagcgtggaccggctggtcaacggggagatcccgtacgccacgcaccacctcacggccgctgcgctcgccgcctccgtgccctgcggcctgtcggtgccctgctccgggacctactccctcaacccctgctccgtcaacctgctcgcgggccagaccagttactttttcccccacgtcccccacccgtcaatgacttcgcagagcagcacgtccatgagcgccagggccgcgtcctcctccacgtcgccgccagcccctcgccccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttctccttttctttaaagaactgtttttttttcttttgtttacttttagaccaaagattgggttctagaaaatgcgccttggtatactaagtattaaaacaaacaaaaaggaaagttgtttcagttggcaacgctgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacataaataaaaaatag

SEQ ID NO: 1133 - DNA, 2897 bp, Homo sapiens
  ref <308>: DATABASE ACCESSION NUMBER: NM_005257
  ref <309>: DATABASE ENTRY DATE: 2001-06-18
ggaattccgcgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggtggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaattttttttttgaatgggatgtcctatggaaacctatttcaccagagttttaaaaataaaaagggtattgttttgtcttctgtaaaaaaaaaaaaaaaaaaaaaaaaaaaaaaaaaaaaaaaaaaa

SEQ ID NO: 1134 - DNA, 2560 bp, Homo sapiens
  ref <308>: DATABASE ACCESSION NUMBER: NM_005264
  ref <309>: DATABASE ENTRY DATE: 2001-06-18
gaattccggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatgtttttcagcaagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacatttttttttttccttttaagaaagcttcttgtgatccttcggggcttctgtgaaaaacctgatgcagtgctccatccaaactcagaaggctttgggatatgctgtattttaaagggacagtttgtaacttgggctgtaaagcaaactggggctgtgttttcgatgatgatgatcatcatgatcatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaaccacccggaattc

SEQ ID NO: 1135 - DNA, 3051 bp, Homo sapiens
  ref <308>: DATABASE ACCESSION NUMBER: NM_005271
  ref <309>: DATABASE ENTRY DATE: 2001-06-18
gggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttaccataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagcttttttttttttttttaactctaacacccttcagaaatttctaactactttgtaactgcatggcttaacctggtgataaaagcagttattaaaagtctacgttttccaaaaaaaaaaaaaaa

SEQ ID NO: 1136 - DNA, 1726 bp, Homo sapiens
  ref <308>: DATABASE ACCESSION NUMBER: NM_005314
  ref <309>: DATABASE ENTRY DATE: 2001-06-18
ccagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctcccatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcatcccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctttatggctagacaggaacccttgcatccattgttgtgtctgtgccctccaaagagccttcagaatgctcctgagtggtgtaggtgggggtggggaggcccaaatgatggatcaccattatattttgaaagaagc

SEQ ID NO: 1137 - DNA, 660 bp, Homo sapiens
  ref <308>: DATABASE ACCESSION NUMBER: NM_005321
  ref <309>: DATABASE ENTRY DATE: 2001-06-18
atgtccgagactgcgcctgccgcgcccgctgctccggcccctgccgagaagactcccgtgaagaagaaggcccgcaagtctgcaggtgcggccaagcgcaaagcgtctgggcccccggtgtccgagctcattactaaagctgttgccgcctccaaggagcgcagcggcgtatctttggccgctctcaagaaagcgctggcagccgctggctatgacgtggagaaaaacaacagccgcatcaagctgggtctcaagagcctggtgagcaagggcaccctggtgcagaccaagggcaccggcgcgtcgggttccttcaaactcaacaagaaggcggcctctggggaagccaagcctaaggctaaaaaggcaggcgcggccaaggccaagaagccagcaggagcggcgaagaagcccaagaaggcgacgggggcggccacccccaagaagagcgccaagaagaccccaaagaaggcgaagaagccggctgcagctgctggagccaaaaaagcgaaaagcccgaaaaaggcgaaagcagccaagccaaaaaaggcgcccaagagcccagcgaaggccaaagcagttaaacccaaggcggctaaaccaaagaccgccaagcccaaggcagccaagccaaagaaggcggcagccaagaaaaagtag

SEQ ID NO: 1138 - DNA, 681 bp, Homo sapiens
  ref <308>: DATABASE ACCESSION NUMBER: NM_005322
  ref <309>: DATABASE ENTRY DATE: 2001-06-18
atgtcggaaaccgctcctgccgagacagccaccccagcgccggtggagaaatccccggctaagaagaaggcaactaagaaggctgccggcgccggcgctgctaagcgcaaagcgacggggcccccagtctcagagctgatcaccaaggctgtggctgcttctaaggagcgcaatggcctttctttggcagcccttaagaaggccttagcggccggtggctacgacgtggagaagaataacagccgcattaagctgggcctcaagagcttggtgagcaagggcaccctggtgcagaccaagggcactggtgcttctggctcctttaaactcaacaagaaggcggcctccggggaagccaagcccaaagccaagaaggcaggcgccgctaaagctaagaagcccgcgggggccacgcctaagaaggccaagaaggctgcaggggcgaaaaaggcagtgaagaagactccgaagaaggcgaagaagcccgcggcggctggcgtcaaaaaggtggcgaagagccctaagaaggccaaggccgctgccaaaccgaaaaaggcaaccaagagtcctgccaagcccaaggcagttaagccgaaggcggcaaagcccaaagccgctaagcccaaagcagcaaaacctaaagctgcaaaggccaagaaggcggctgccaaaaagaagtag

SEQ ID NO: 1139 - DNA, 648 bp, Homo sapiens
  ref <308>: DATABASE ACCESSION NUMBER: NM_005325
  ref <309>: DATABASE ENTRY DATE: 2001-06-18
atgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctagtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaa

SEQ ID NO: 1140 - DNA, 1011 bp, Homo sapiens
  ref <308>: DATABASE ACCESSION NUMBER: NM_005326
  ref <309>: DATABASE ENTRY DATE: 2001-06-18
gatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataaaaaaaaaaaaaa

SEQ ID NO: 1141 - DNA, 1968 bp, Homo sapiens
  ref <308>: DATABASE ACCESSION NUMBER: NM_005335
  ref <309>: DATABASE ENTRY DATE: 2001-06-18
aattccgccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcatacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgctccaccccctccctattcctgatgcaaatgtctaaccagatgagtttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 1142 - DNA, 3837 bp, Homo sapiens
  ref <308>: DATABASE ACCESSION NUMBER: NM_005337
  ref <309>: DATABASE ENTRY DATE: 2001-06-18
tcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcataccatagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaagcccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttgtggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagccc

SEQ ID NO: 1143 - DNA, 1633 bp, Homo sapiens
  ref <308>: DATABASE ACCESSION NUMBER: NM_005342
  ref <309>: DATABASE ENTRY DATE: 2001-06-18
cgtggaggcagctagcgcgaggctggggagcgctgagccgcgcgtcgtgccctgcgctgcccagactagcgaacaatacagtcgggatggctaaaggtgaccccaagaaaccaaagggcaagacgtccgcttatgccttctttgtgcagacatgcagagaagaacataagaagaaaaacccagaggtccctgtcaattttgcggaattttccaagaagtgctctgagaggtggaagacggtgtccgggaaagagaaatccaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaacaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatatttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccgttgtatttggagactggcctccctataaatgtg

SEQ ID NO: 1144 - DNA, 2387 bp, Homo sapiens
  ref <308>: DATABASE ACCESSION NUMBER: NM_005345
  ref <309>: DATABASE ENTRY DATE: 2001-06-18
gctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 1145 - DNA, 3804 bp, Homo sapiens
  ref <308>: DATABASE ACCESSION NUMBER: NM_005357
  ref <309>: DATABASE ENTRY DATE: 2001-06-18
cttcttgtaagagagtgctaggcacatagccccctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacatcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcgcagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgcttacttaagtcgggggtggcaagggggcggggcgggggccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaatta

SEQ ID NO: 1146 - DNA, 3225 bp, Homo sapiens
  ref <308>: DATABASE ACCESSION NUMBER: NM_005375
  ref <309>: DATABASE ENTRY DATE: 2001-06-18
ggcggcagcgccctgccgacgccggggagggacgcaggcaggcggcgggcagcgggaggcggcaccccggtgctccccgcggctctcggcggagccccgccgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggatttgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtgcgagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacagttcaagttgacttgggatatatcattcctcaacatgaaacttttcatgaatgggagaagaacctatttttgttgtggtacaacagttgagagcacgaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaaacataaaatgatttatctggtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttcatgttctatgttttgttttgtgtgtagcctgactgttttataatttgggagttctcgatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 1147 - DNA, 1599 bp, Homo sapiens
  ref <308>: DATABASE ACCESSION NUMBER: NM_005391
  ref <309>: DATABASE ENTRY DATE: 2001-06-18
gtggtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctaggcccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacatctgatatgtgctgcaacatgggtgaatcttgaagtcattatgctaagtgaaataaaccagacataaaaggacaaatacatcg

SEQ ID NO: 1148 - DNA, 860 bp, Homo sapiens
  ref <308>: DATABASE ACCESSION NUMBER: NM_005408
  ref <309>: DATABASE ENTRY DATE: 2001-06-18
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccaaaaaaaaaaa

SEQ ID NO: 1149 - DNA, 1493 bp, Homo sapiens
  ref <308>: DATABASE ACCESSION NUMBER: NM_005409
  ref <309>: DATABASE ENTRY DATE: 2001-06-18
ttcctttcatgttcagcatttctactccttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagggcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccagcaattaaatggatttctaggaaaagctaccttaagaaaggctggttaccatcggagtttacaaagtgctttcacgttcttacttgttgtattatacattcatgcatttctaggctagagaaccttctagatttgatgcttacaactattctgttgtgactatgagaacatttctgtctctagaagttatctgtctgtattgatctttatgctatattactatctgtggttacagtggagacattgacattattactggagtcaagcccttataagtcaaaagcatctatgtgtcgtaaagcattcctcaaacattttttcatgcaaatacacayttctttccccaaatatcatgtagcacatcaatatgtagggaaacattcttatgcatcatttggtttgttttataaccaattcattaaatgtaattcataaaatgtactatgaaaaaaattatacgctatgggatactggcaacagtgcacatatttcataaccaaattagcagcaccggtcttaatttgatgtttttcaacttttattcattgagatgttttgaagcaattaggatatgtgtgtttactgtactttttgttttgatccgtttgtataaatgatagcaatatcttggacacatttgaaatacaaaatgtttttgtctaccaaagaaaaatgttgaaaaataagcaaatgtatacctagcaatcacttttactttttgtaattctgtctcttagaaaaatacataatctaatcaatttctttgttcatgcctatatactgtaaaatttaggtatactcaagactagtttaaagaatcaaagtcatttttttctctaataaactaccacaacctttcttttttaaaaaaaaaaa

SEQ ID NO: 1150 - DNA, 2038 bp, Homo sapiens
  ref <308>: DATABASE ACCESSION NUMBER: NM_005410
  ref <309>: DATABASE ENTRY DATE: 2001-06-18
gcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatcatcgaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggttttctgttggataattagcagtttagaatggaggaagaacaacaaagacatgctttccattttttcctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaaggcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaaaaaaaaaaaaaaaaaaaaa

SEQ ID NO: 1151 - DNA, 4534 bp, Homo sapiens
  ref <308>: DATABASE ACCESSION NUMBER: NM_005426
  ref <309>: DATABASE ENTRY DATE: 2001-06-18
gtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgtagagatagagtttcatcatgttggccaggatggtctcgatctcctgaccttgtgatccgcctgcctcggcctcccaaagtgctggattacaggtgtgagccaccacgatcagcctctagtgtttaaaaaagaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcatctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctgcccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggccttggggctcactgaaggctcgaaggcactgcacaccttgtatattgtcagtgaagaacgttagttggttgtcagtgaacaataactttattatatgagtttttgtagcatcttaagaattatacatatgtttgaaatattgaaactaagctacagtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgct

SEQ ID NO: 1152 - DNA, 4517 bp, Homo sapiens
  ref <308>: DATABASE ACCESSION NUMBER: NM_005433
  ref <309>: DATABASE ENTRY DATE: 2001-06-18
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagcccttttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgccgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatctgcccgcctcggcctcccaaagtgctgggattacaggtgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcgtatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacc

SEQ ID NO: 1153 - DNA, 2197 bp, Homo sapiens
  ref <308>: DATABASE ACCESSION NUMBER: NM_005441
  ref <309>: DATABASE ENTRY DATE: 2001-06-18
tcttgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacatagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttgg

SEQ ID NO: 1154 - DNA, 1872 bp, Homo sapiens
  ref <308>: DATABASE ACCESSION NUMBER: NM_005443
  ref <309>: DATABASE ENTRY DATE: 2001-06-18
atggagatccccgggagcttgtgcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttcgcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttattttaggaacacgaatgcgcaaacttgctcgagaaggccagaaaccacctgaaggtttcatggctcccaaggcttggaccgtgctgacagaatactacaaatccttggagaaagcttag

SEQ ID NO: 1155 - DNA, 3111 bp, Homo sapiens
  ref <308>: DATABASE ACCESSION NUMBER: NM_005483
  ref <309>: DATABASE ENTRY DATE: 2001-06-18
ggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggacgccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaacgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagctgcgggcacagga

SEQ ID NO: 1156 - DNA, 2177 bp, Homo sapiens
  ref <308>: DATABASE ACCESSION NUMBER: NM_005486
  ref <309>: DATABASE ENTRY DATE: 2001-06-18
gcactagggggcccggcctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgcgccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactatt

SEQ ID NO: 1157 - DNA, 4086 bp, Homo sapiens
  ref <308>: DATABASE ACCESSION NUMBER: NM_005496
  ref <309>: DATABASE ENTRY DATE: 2001-06-18
tttttatttttttcgagtgaaggacccggagccgaaacaccggtagagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatg

SEQ ID NO: 1158 - DNA, 1711 bp, Homo sapiens
  ref <308>: DATABASE ACCESSION NUMBER: NM_005498
  ref <309>: DATABASE ENTRY DATE: 2001-06-18
gcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatct

SEQ ID NO: 1159 - DNA, 2617 bp, Homo sapiens
  ref <308>: DATABASE ACCESSION NUMBER: NM_005499
  ref <309>: DATABASE ENTRY DATE: 2001-06-18
cgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtt

SEQ ID NO: 1160 - DNA, 1089 bp, Homo sapiens
  ref <308>: DATABASE ACCESSION NUMBER: NM_005514
  ref <309>: DATABASE ENTRY DATE: 2001-06-18
atgctggtcatggcgccccgaaccgtcctcctgctgctctcggcggccctggccctgaccgagacctgggccggctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagtggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 1161 - DNA, 2058 bp, Homo sapiens
  ref <308>: DATABASE ACCESSION NUMBER: NM_005518
  ref <309>: DATABASE ENTRY DATE: 2001-06-18
cggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattggcccaaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtatatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgcctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagaaaaaaaaaaaaaaa

SEQ ID NO: 1162 - DNA, 2709 bp, Homo sapiens
  ref <308>: DATABASE ACCESSION NUMBER: NM_005531
  ref <309>: DATABASE ENTRY DATE: 2001-06-18
gggaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtgcatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccagcttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaacacaatcaactgtgaggaaggagataaactgaaactcaccagctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtccctaaaaaaatgtacatatacctggttgaaatacaacactatacatacacaccaccatatatactagctgttaatcctatggaatgggggtattgggagtgcttttttaatttttcatagtttttttttaataaaatggcatattttgcatctacaacttctataataagaaaaaataaataaacattatcttttttgtgaaaaaaa

SEQ ID NO: 1163 - DNA, 2272 bp, Homo sapiens
  ref <308>: DATABASE ACCESSION NUMBER: NM_005538
  ref <309>: DATABASE ENTRY DATE: 2001-06-18
caaggagccatgccagctggacacacacttcttccagggcctctggcagccaggacagagttgagaccacagctgttgagaccctgagccctgagtctgtattgctcaagaagggccttccccagcaatgacctcctcattgcttctggcctttctcctcctggctccaaccacagtggccactcccagagctggcggtcagtgtccagcatgtggggggcccaccttggaactggagagccagcgggagctgcttcttgatctggccaagagaagcatcttggacaagctgcacctcacccagcgcccaacactgaaccgccctgtgtccagagctgctttgaggactgcactgcagcacctccacggggtcccacagggggcacttctagaggacaacagggaacaggaatgtgaaatcatcagctttgctgagacaggcctctccaccatcaaccagactcgtcttgattttcacttctcctctgatagaactgctggtgacagggaggtccagcaggccagtctcatgttctttgtgcagctcccttccaataccacttggaccttgaaagtgagagtccttgtgctgggtccacataataccaacctcaccttggctactcagtacctgctggaggtggatgccagtggctggcatcaactccccctagggcctgaagctcaagctgcctgcagccaggggcacctgaccctggagctggtacttgaaggccaggtagcccagagctcagtcatcctgggtggagctgcccataggccttttgtggcagcccgggtgagagttgggggcaaacaccagattcaccgacgaggcatcgactgccaaggagggtccaggatgtgctgtcgacaagagttttttgtggacttccgtgagattggctggcacgactggatcatccagcctgagggctacgccatgaacttctgcatagggcagtgcccactacacatagcaggcatgcctggtattgctgcctcctttcacactgcagtgctcaatcttctcaaggccaacacagctgcaggcaccactggagggggctcatgctgtgtacccacggcccggcgccccctgtctctgctctattatgacagggacagcaacattgtcaagactgacatacctgacatggtagtagaggcctgtgggtgcagttagtctatgtgtggtatgggcagcccaaggttgcatgggaaaacacgcccctacagaagtgcacttccttgagaggagggaatgacctcattctctgtccagaatgtggactccctcttcctgagcatcttatggaaattaccccacctttgacttgaagaaaccttcatctaaagcaagtcactgtgccatcttcctgaccactaccctctttcctagggcatagtccatcccgctagtccatcccgctagccccactccagggactcagacccatctccaaccatgagcaatgccatctggttcccaggcaaagacacccttagctcacctttaatagaccccataacccactatgccttcctgtcctttctactcaatggtccccactccaagatgagttgacacaaccccttcccccaatttttgtggatctccagagaggcccttctttggattcaccaaagtttagatcactgctgcccaaaatagaggcttacctacccccctctttgttgtgagcccctgtccttcttagttgtccaggtgaactactaaagctctctttgcataccttcatccattttttgtccttctctgcctttctctatgcccttaaggggtgacttgcctgagctctatcacctgagctcccctgccctctggcttcctgctgaggtcagggcatttcttatccctgttccctctctgtctaggtgtcatggttctgtgtaactgtggctattctgtgtccctacactacctggctacccccttccatggccccagctctgcctacattctgattttttttttttttttttttttgaaaagttaaaaattccttaattttttattcctggtaccactaccacaatttacagggcaatatacctgatgtaatgaaaagaaaaagaaaaagacaaagctacaacagataaaagacctcaggaatgtacatctaattgacactacattgcattaatcaatagctgcactttttgcaaactgtggctatgacagtcctgaacaagaagggtttcctgtttaagctgcagtaacttttctgactatggatcatcgttcctt

SEQ ID NO: 1164 - DNA, 4906 bp, Homo sapiens
  ref <308>: DATABASE ACCESSION NUMBER: NM_005541
  ref <309>: DATABASE ENTRY DATE: 2001-06-18
gttgctgtcgccgttgctgtcggccgaggccaccaagaggcaacgggcggcaggttgcagtggaggggcctccgctcccctcggtggtgtgtgggtcctgggggtgcctgccggcccagccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctgattaagtcacagaaatttctgaataagttggtgatcttggtggaaacggagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgtatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgccttgttgagggcgccattctgaagaaaggaactgcagcgccgatttgagggtggagatatagataataataatattaataataataatggccacatggatcgaacactcatggtgtgccaagtgctgtgctaagtgctttacgaacattcgtcatatcaggatgacctcgagagctgaggctctagcacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactcaaaacc

SEQ ID NO: 1165 - DNA, 5828 bp, Homo sapiens
  ref <308>: DATABASE ACCESSION NUMBER: NM_005544
  ref <309>: DATABASE ENTRY DATE: 2001-06-18
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttaaaaaaaaaaaaaaaaaaaaaaaaaaaaa

SEQ ID NO: 1166 - DNA, 1997 bp, Homo sapiens
  ref <308>: DATABASE ACCESSION NUMBER: NM_005548
  ref <309>: DATABASE ENTRY DATE: 2001-06-18
gtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttgggctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgtta

SEQ ID NO: 1167 - DNA, 1695 bp, Homo sapiens
  ref <308>: DATABASE ACCESSION NUMBER: NM_005554
  ref <309>: DATABASE ENTRY DATE: 2001-06-18
atggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaa

SEQ ID NO: 1168 - DNA, 1695 bp, Homo sapiens
  ref <308>: DATABASE ACCESSION NUMBER: NM_005555
  ref <309>: DATABASE ENTRY DATE: 2001-06-18
atggccagcacatccaccaccatcaggagccacagcagcagccgccggggtttcagtgccagctcagccaggctccctggggtcagccgctctggcttcagcagcatctccgtgtcccgctccaggggcagtggtggcctgggtggcgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggtcgtctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactcttacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcaggtcacagcaggcagacatggggacgacctgcgcaacaccaagcaggagattgctgagatcaaccgcatgatccagaggctgagatctgagatcgaccacgtcaagaagcagtgtgccaacctacaggctgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggacgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactga

SEQ ID NO: 1169 - DNA, 1466 bp, Homo sapiens
  ref <308>: DATABASE ACCESSION NUMBER: NM_005556
  ref <309>: DATABASE ENTRY DATE: 2001-06-18
acggcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaaggccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggagcaggggctgcggacgatgcaggatgtggtggaggacttcaagaataagtacgaagatgaaattaaccgccgcacagctgctgagaatgagtttgtggtcctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagtgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactga

SEQ ID NO: 1170 - DNA, 1413 bp, Homo sapiens
  ref <308>: DATABASE ACCESSION NUMBER: NM_005557
  ref <309>: DATABASE ENTRY DATE: 2001-06-18
atgaccacctgcagccgccagttcacctcctccagctccatgaagggctcctgcggcatcggaggcggcatcggggcgggctccagccgcatctcctccgtcctggccggggcctcctgccctgccagcacctacgggggcgcctctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcacgcccttttgcagattgacaatgccaggctggcagccgatgacttcaggaccaagtatgaggcacgaactggcctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcaggatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcagccgtcagacccggcccatcctcagagcagagctcatccagcttcagccagggccagagctcctag

SEQ ID NO: 1171 - DNA, 2442 bp, Homo sapiens
  ref <308>: DATABASE ACCESSION NUMBER: NM_005558
  ref <309>: DATABASE ENTRY DATE: 2001-06-18
gcgggattccgggccgggccggcctgggctgcaatcaatgcggctttgtctgggacgcccacatcccagaggccattcccgggtcggcaaatcggagcgcggcggggcgcgcgggggtgagataagcggccatgtgatcccacctgggctggaaggggaggggcgccaggtgaggcggcggccggtggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctggcccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttcccttgttggctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccaacaagtgcctctttgtctatgatgtcccccttctctgaggcctggacccacccatctttgtccctgggggctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 1172 - DNA, 5175 bp, Homo sapiens
  ref <308>: DATABASE ACCESSION NUMBER: NM_005562
  ref <309>: DATABASE ENTRY DATE: 2001-06-18
acagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaacgctggtaaccaggcatatggatgagttcaagcgtacacaaaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgcc

SEQ ID NO: 1173 - DNA, 1436 bp, Homo sapiens
  ref <308>: DATABASE ACCESSION NUMBER: NM_005563
  ref <309>: DATABASE ENTRY DATE: 2001-06-18
agtgtggtcaggcggctcggactgagcaggactttccttatcccagttgattgtgcagaatacactgcctatcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgt

SEQ ID NO: 1174 - DNA, 1984 bp, Homo sapiens
  ref <308>: DATABASE ACCESSION NUMBER: NM_005565
  ref <309>: DATABASE ENTRY DATE: 2001-06-18
gaagagaccatatttgttcgcagaggaagccgttgctttctgggatctggctacggcagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggttggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccc

SEQ ID NO: 1175 - DNA, 1661 bp, Homo sapiens
  ref <308>: DATABASE ACCESSION NUMBER: NM_005566
  ref <309>: DATABASE ENTRY DATE: 2001-06-18
tgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatatttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtg

SEQ ID NO: 1176 - DNA, 2029 bp, Homo sapiens
  ref <308>: DATABASE ACCESSION NUMBER: NM_005572
  ref <309>: DATABASE ENTRY DATE: 2001-06-18
actcagtgttcgcgggagccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccatgtgagtggtagccgccgctgaggccgagcctgcactggggccacccagccaggcctgggggcagcctctccccagcctccccgtgccaaaaatcttttcattaaagaatgtttggaacttt

SEQ ID NO: 1177 - DNA, 2697 bp, Homo sapiens
  ref <308>: DATABASE ACCESSION NUMBER: NM_005582
  ref <309>: DATABASE ENTRY DATE: 2001-06-18
gctgagcagtcaacagcatttcttgttccaagatcacccttctgagtacctctctggctgccaaattgccagggccttcacagtttgattccattctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacggtcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagactgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaggaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactaccgacatccctcccagcaccacacaccccgcccctgaaaggagatcatcagcccccacaatttgtcagagctgaagccagcccactacccacccccactacagcattgtgcttgggtctgggttctcagtaaatgtagccatttgagaaacttacttggggacaaagtctcaatccttattttaaatgaaaaaagaaaagaaaagcataataaatttaaaagaaaagg

SEQ ID NO: 1178 - DNA, 916 bp, Homo sapiens
  ref <308>: DATABASE ACCESSION NUMBER: NM_005608
  ref <309>: DATABASE ENTRY DATE: 2001-06-18
acttctcgctcgacacagccagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcacccctaccagttcccaagtccatgtgtaccccgctcaccacgggaacggccccccccaaccacaggcatcaggcaaccatttgaaataaaactccttcagcctgtgaaaaaaaaaa

SEQ ID NO: 1179 - DNA, 987 bp, Homo sapiens
  ref <308>: DATABASE ACCESSION NUMBER: NM_005614
  ref <309>: DATABASE ENTRY DATE: 2001-06-18
ccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctc

SEQ ID NO: 1180 - DNA, 589 bp, Homo sapiens
  ref <308>: DATABASE ACCESSION NUMBER: NM_005617
  ref <309>: DATABASE ENTRY DATE: 2001-06-18
ctccgccctctcccactctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaaaaaaaaaaaaaaaa

SEQ ID NO: 1181 - DNA, 595 bp, Homo sapiens
  ref <308>: DATABASE ACCESSION NUMBER: NM_005620
  ref <309>: DATABASE ENTRY DATE: 2001-06-18
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaa

SEQ ID NO: 1182 - DNA, 2193 bp, Homo sapiens
  ref <308>: DATABASE ACCESSION NUMBER: NM_005625
  ref <309>: DATABASE ENTRY DATE: 2001-06-18
ggcacgaggcgggggcggtgcatgacgcgcctcgggggcggtcctcgggcgcgcaccgctctcttacactcgggcctcagaagtccgtgccagtgaccggagcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaagtgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctggggatcttactctttcatctgataccttgttcagatttcaaaatagttgtagccttatcctggttttacagatgtgaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgtcatattactttagttctatagcatacttgcatctttaacatgctatcatagtacatttagaatgattgcctttgatttttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttttttttggtttatgtctattctaattaaatatgtataaataaagttacattttagtctgtcaaaaaaaaaaaaaaaaaaaaaaaaaaaaaaa

SEQ ID NO: 1183 - DNA, 1712 bp, Homo sapiens
  ref <308>: DATABASE ACCESSION NUMBER: NM_005651
  ref <309>: DATABASE ENTRY DATE: 2001-06-18
aaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaatcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttcaaaaaaaaaaaaaaaaaaaa

SEQ ID NO: 1184 - DNA, 2380 bp, Homo sapiens
  ref <308>: DATABASE ACCESSION NUMBER: NM_005658
  ref <309>: DATABASE ENTRY DATE: 2001-06-18
gccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctagcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttcccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagggaattcaaaaaaaaaaaaaaaaa

SEQ ID NO: 1185 - DNA, 1156 bp, Homo sapiens
  ref <308>: DATABASE ACCESSION NUMBER: NM_005659
  ref <309>: DATABASE ENTRY DATE: 2001-06-18
ggcacgaggaagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcatggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggaatttgtggctgatgaaggcatctgctacctcccacactggatgatgcagaacttactcttggaagaagacggcctggtccagttggagaccgtcaaccttcaagtggccacctactccaagagtaagttctgctacctcccacactggatgatgcagaacttactcttggaagaaggcggcctggtccaggtggagagcgtcaaccttcaagtggccacctactccaaattccaacctcagagcgctgacttcctggacatcaccaaccccaaagccgtattagaaaacgcacttaggaactttgcctgtctgaccaccggggatgtgattgccattaactacaatgaaaagatctacgaactgcgtgtgatggagaccaaacccgacaaggcagtgtccattcatgagtgtgacatgaacgtggactttgatgctcccctgggctacaaagaacccgaaagacaagtccagcatgaggagtcgacagaaggtgaagccgaccacagtggctatgctggagagcttggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagtttcatttgca

SEQ ID NO: 1186 - DNA, 3423 bp, Homo sapiens
  ref <308>: DATABASE ACCESSION NUMBER: NM_005667
  ref <309>: DATABASE ENTRY DATE: 2001-06-18
acggccgcggtctccggaggtggcgggggtgttggggacgggtgctgcgaccggcactgcccatccgagcgggacgggcgctgagtggccgggaggagccgggtagccgcctggaggagcagtctcggggcctattattggttttttccctccgagaccgattccatctgcagagaccgcgacgccccatcctgggccgggccgcagtgccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccccgcagaacacgctgggccccgggcctggcccggccgagcgccgcgccctcctgacccgcggccgcggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccggggaagcgtccctcgttttgttcttccccgcgagctctcccgcgcgcccctctcctttctgtgcttaatggatggggttttgagtttttcccctttatttttgtcggctcttgactgggaggcccggcgcgaggctctgcgtctctgcgtccctcgtcgccgcctcgcgcccgcgcggatcccgtcacctgcttcccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccag

SEQ ID NO: 1187 - DNA, 3493 bp, Homo sapiens
  ref <308>: DATABASE ACCESSION NUMBER: NM_005686
  ref <309>: DATABASE ENTRY DATE: 2001-06-18
atgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagcgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggtgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaaaaaaaaaaaaaaaaa

SEQ ID NO: 1188 - DNA, 2445 bp, Homo sapiens
  ref <308>: DATABASE ACCESSION NUMBER: NM_005690
  ref <309>: DATABASE ENTRY DATE: 2001-06-18
ggaggcgaactgtgggccccggccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtgacacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggctgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattctaaattgcagaacacatcacacatttaatccaaataataaatggctgtttcaaaaaaaaaaaaaaaaaaaaaaaaaaaaaaaaaaaaaaaaaaaaaaaaaaaaaaaaaaaaaaaaaaaaaaaaaaa

SEQ ID NO: 1189 - DNA, 820 bp, Homo sapiens
  ref <308>: DATABASE ACCESSION NUMBER: NM_005718
  ref <309>: DATABASE ENTRY DATE: 2001-06-18
cagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaaaaaaaaaaaaaaaaaaa

SEQ ID NO: 1190 - DNA, 1428 bp, Homo sapiens
  ref <308>: DATABASE ACCESSION NUMBER: NM_005720
  ref <309>: DATABASE ENTRY DATE: 2001-06-18
ggcacgagggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctaactgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaaaaaaaa

SEQ ID NO: 1191 - DNA, 1076 bp, Homo sapiens
  ref <308>: DATABASE ACCESSION NUMBER: NM_005727
  ref <309>: DATABASE ENTRY DATE: 2001-06-18
atgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccgagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggc

SEQ ID NO: 1192 - DNA, 2972 bp, Homo sapiens
  ref <308>: DATABASE ACCESSION NUMBER: NM_005733
  ref <309>: DATABASE ENTRY DATE: 2001-06-18
tcttcggacctaggctgccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcgtttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaaaaaaaaaaaaaa

SEQ ID NO: 1193 - DNA, 625 bp, Homo sapiens
  ref <308>: DATABASE ACCESSION NUMBER: NM_005737
  ref <309>: DATABASE ENTRY DATE: 2001-06-18
cgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtg

SEQ ID NO: 1194 - DNA, 1882 bp, Homo sapiens
  ref <308>: DATABASE ACCESSION NUMBER: NM_005742
  ref <309>: DATABASE ENTRY DATE: 2001-06-18
gaattcgggcgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctactttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggaaaaaagaaaaaaaaaaaaaggaattc

SEQ ID NO: 1195 - DNA, 2376 bp, Homo sapiens
  ref <308>: DATABASE ACCESSION NUMBER: NM_005746
  ref <309>: DATABASE ENTRY DATE: 2001-06-18
cgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtgg

SEQ ID NO: 1196 - DNA, 1206 bp, Homo sapiens
  ref <308>: DATABASE ACCESSION NUMBER: NM_005749
  ref <309>: DATABASE ENTRY DATE: 2001-06-18
gttgctgtcggggagttgaaacctaattttgtggcgtagagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttttaagcttatagtaaggatacattcaagcttgggttaaaaa

SEQ ID NO: 1197 - DNA, 3216 bp, Homo sapiens
  ref <308>: DATABASE ACCESSION NUMBER: NM_005760
  ref <309>: DATABASE ENTRY DATE: 2001-06-18
gctttgccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaaggggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattgcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatct

SEQ ID NO: 1198 - DNA, 927 bp, Homo sapiens
  ref <308>: DATABASE ACCESSION NUMBER: NM_005764
  ref <309>: DATABASE ENTRY DATE: 2001-06-18
ggaagtttaggttaactgtcttaaatttccaaagctgtaatcattattttcattctcaaagtgatggccttgtgttttgctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttccaaaa

SEQ ID NO: 1199 - DNA, 1442 bp, Homo sapiens
  ref <308>: DATABASE ACCESSION NUMBER: NM_005794
  ref <309>: DATABASE ENTRY DATE: 2001-06-18
ggttcccttccacgctgtgaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattataaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccagcccaggagcctgagggggtgtctaggtgatcatttggatctggagcagagtctgccattctgccagactagcaatttgggggcttactcatgctaggcttgaggaagaagaaaaacgcttcggcattctcc

SEQ ID NO: 1200 - DNA, 894 bp, Homo sapiens
  ref <308>: DATABASE ACCESSION NUMBER: NM_005796
  ref <309>: DATABASE ENTRY DATE: 2001-06-18
ggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtccttttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacaaaaaaaaa

SEQ ID NO: 1201 - DNA, 1512 bp, Homo sapiens
  ref <308>: DATABASE ACCESSION NUMBER: NM_005804
  ref <309>: DATABASE ENTRY DATE: 2001-06-18
cggaagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaggaggaagagccccaggctcctcaagagagcacaccagctccccctaagaaagacatcaagggatcctacgtttccatccacagctctggcttccgggactttctgctgaagccggagctcctgcgggccatcgtggactgtggcttggagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgatgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccgccctgtgtgcaggaagttcatgcaggatcccatggaggtgtttgtggacgacgagaccaagctcacgctgcacgggctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggggggtcgctttggcaccaaaggcctagccatcacttttgtgtctgacgagaatgatgccaaaatcctcaatcacgtccaggaccggtgtgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaagtgttattatgaaatgaagaagcctcaccca

SEQ ID NO: 1202 - DNA, 5792 bp, Homo sapiens
  ref <308>: DATABASE ACCESSION NUMBER: NM_005813
  ref <309>: DATABASE ENTRY DATE: 2001-06-18
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttcttcgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaaaaaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagccagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagttttacctggttgtgttattttaccagac

SEQ ID NO: 1203 - DNA, 2002 bp, Homo sapiens
  ref <308>: DATABASE ACCESSION NUMBER: NM_005824
  ref <309>: DATABASE ENTRY DATE: 2001-06-18
tataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggcgaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgggtctttgagatgaaaccctgcaagtagacttacgtgaatgatttttgctgtgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgttta

SEQ ID NO: 1204 - DNA, 2309 bp, Homo sapiens
  ref <308>: DATABASE ACCESSION NUMBER: NM_005825
  ref <309>: DATABASE ENTRY DATE: 2001-06-18
cgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttc

SEQ ID NO: 1205 - DNA, 1019 bp, Homo sapiens
  ref <308>: DATABASE ACCESSION NUMBER: NM_005849
  ref <309>: DATABASE ENTRY DATE: 2001-06-18
ttcctttcaaatacacaccccaacccgccccggcatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagacaagttcacagtgagggaggccctcaaagaaaaccaagtttccctcactgtaaacagagtgacttcaaatgacagtgcaatttacatctgtggaatagcattccccagtgtgccggaagcgagagctaaacagacaggaggagggaccacactggtggtaagagaaattaagctgctcagcaaggaactgcggagcttcctgacagctcttgtatcactgctctctgtctatgtgaccggtgtgtgcgtggccttcatactcctctccaaatcaaaatccaaccctctaagaaagaaagaaataaaagaagactcacaaaagaagaagagtgctcggcgtatttttcaggaaattgctcaagaactataccataagagacatgtggaaacaaatcagcaatctgagaaagataacaacacttatgaaaacagaagagtactttccaactatgaaaggccatagaaacgttttaattttcaatgaagtcactgaaaatccaactccaggagctatggcagtgttaatgaacatatatcatcaggtcttaaaaaaaaaataaaggtaaactgaaaagacaactggctacaaagaaggatgtcagaatgtaaggaaactataactaatagtcattaccaaaatactaaaacccaacaaaatgcaactgaaaaataccttccaaatttgccaagaaaaaaaattctattyyaaact

SEQ ID NO: 1206 - DNA, 1254 bp, Homo sapiens
  ref <308>: DATABASE ACCESSION NUMBER: NM_005853
  ref <309>: DATABASE ENTRY DATE: 2001-06-18
atggcagtggagaccacggtccacactcacctctctgcgtctccaccgcagggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacattgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaa

SEQ ID NO: 1207 - DNA, 800 bp, Homo sapiens
  ref <308>: DATABASE ACCESSION NUMBER: NM_005855
  ref <309>: DATABASE ENTRY DATE: 2001-06-18
cgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttg

SEQ ID NO: 1208 - DNA, 3114 bp, Homo sapiens
  ref <308>: DATABASE ACCESSION NUMBER: NM_005864
  ref <309>: DATABASE ENTRY DATE: 2001-06-18
ctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcgacccagctggcccgggcactgtatgacaacaccgctgagtccccccaggagctgtccttccgccgaggggatgtcctacgggtcctgcagagagagggcgctggtggactggacggctggtgcctctgctccctacacggccagcagggcattgtgcccgccaacagggtgaagctcttgcctgctggcccagcacccaagcccagcctctctcctgcgtccccagcccagcctggctcaccatatccagccccagatcacagcaatgaggaccaggaggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgacgcgccaggcacagttctgcaagtatattgtgaatgtattgttctagtgggatacacaaataagtcagttaaaatacataaataaaaacataaacctgc

SEQ ID NO: 1209 - DNA, 2221 bp, Homo sapiens
  ref <308>: DATABASE ACCESSION NUMBER: NM_005874
  ref <309>: DATABASE ENTRY DATE: 2001-06-18
gctcactgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataaaagcaggtcgtctcgttccaatct

SEQ ID NO: 1210 - DNA, 1271 bp, Homo sapiens
  ref <308>: DATABASE ACCESSION NUMBER: NM_005876
  ref <309>: DATABASE ENTRY DATE: 2001-06-18
cactgaccgtgagacccggtgggtctacatccccttttagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgcgctccccccgctaccctccgagccgcgcccctgtctcaggcacctctcggacctcgctgtgtttcactgcctcctgcccacagacccagctgccggcccggacccgtcccagcctcccctccccaccccatgcagcccccagggggatagcccatgggcccctgtggaccctccctccccaagtggacacatggctgtgcagccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggattcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacctaaaaaaaaaa

SEQ ID NO: 1211 - DNA, 1993 bp, Homo sapiens
  ref <308>: DATABASE ACCESSION NUMBER: NM_005880
  ref <309>: DATABASE ENTRY DATE: 2001-06-18
ccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatcccagatgaactgagggacatctgttggtctatgtataacttttaaaattggtatagtatctacagagtgtataatttaaactaaccacaaagctttacatcttcattttgactgttccatagcaaaataaagcacttgaaaggaaacaaaactccctttcacacatggattattataagtttcaatcctggtatctgtgcttgatttttatcagttttgtgtaaatttttatgtttcatattttaaatttaaatcccacattgtaaagtttgtacaatttgtcctgaagctttgtgtttggctgcacctgcataagctgctacaaataaaataaaaaatttcatagcctgtatctatcatttaaatgcatggaaaaaaatgggctttgcacacaatgggtttggagctgactgggaacaatggaaaaaattacattagctgtggttgtaaagtttttttgtttttgggttttgttttttttttgttttttttttttttttttttaccattttgtgaaaggtttttgaaaatcgataataaaaagcggttggtgtaaatttaaaaaaaaaaaaaaaaaaaaaaaaaaaaaaaaaaaaaaaaaaaaaaaaaaaaaaa

SEQ ID NO: 1212 - DNA, 1490 bp, Homo sapiens
  ref <308>: DATABASE ACCESSION NUMBER: NM_005891
  ref <309>: DATABASE ENTRY DATE: 2001-06-18
ggggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccacaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgttgctcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgacaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcacggtacaagacaattgcatttaacattgttataaataaaaggaacatcagatcaatcattaaaaaaaaaaaa

SEQ ID NO: 1213 - DNA, 1789 bp, Homo sapiens
  ref <308>: DATABASE ACCESSION NUMBER: NM_005892
  ref <309>: DATABASE ENTRY DATE: 2001-06-18
agagtgaaggccaagaagcccatccagactaagttccgaatgccactcttgaactgggtggcattgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaagaaaaaaaaa

SEQ ID NO: 1214 - DNA, 4394 bp, Homo sapiens
  ref <308>: DATABASE ACCESSION NUMBER: NM_005899
  ref <309>: DATABASE ENTRY DATE: 2001-06-18
ggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaaaaaaaaaaaaaa

SEQ ID NO: 1215 - DNA, 2917 bp, Homo sapiens
  ref <308>: DATABASE ACCESSION NUMBER: NM_005915
  ref <309>: DATABASE ENTRY DATE: 2001-06-18
ggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctg

SEQ ID NO: 1216 - DNA, 1671 bp, Homo sapiens
  ref <308>: DATABASE ACCESSION NUMBER: NM_005919
  ref <309>: DATABASE ENTRY DATE: 2001-06-18
cgggggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccaaaaaaa

SEQ ID NO: 1217 - DNA, 5211 bp, Homo sapiens
  Modified_base 1 ... 5211: n = a,c,g, or t
  ref <308>: DATABASE ACCESSION NUMBER: NM_005923
  ref <309>: DATABASE ENTRY DATE: 2001-06-18
cgagcgcggcgcccttgagctgcaccgcggcgcaggtttgcgagccgacttgtcagccggccaagaaaaggaagctccgtcccttcccgctcacccggcttccccaccccttgtactctaaactctgcacagggcgagcggcgcggccactgatgcgccgaggaggagcgagccgccgccgggcagcggcgtgccctcgggggagagggcgccggataagagcggcggcgcggcggcgatggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgaaggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagargagaaaggcgctgcmctttaaatccagtatttgtttactcatgttaaaaaaaaaaaaaacagacaaaacacactgaaatttcctaactacatctatttctataatttttaaggactnttcataaggactcttaaaataatcctgaacattagaaccctaatgttcaggaagattttaatctaagcatttttatggaaatatttttaatgcagcagctattgcacttcagccaaatgtttatttcacacaaaacggatgtaacattcatgtgatcgtgcacccactggacaaaccaaaatgtgaccataactgtttaggttctgtgtgtttgtaatatgtctaataatctggagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacaaaaaaaaaaaaaaaaaaaaa

SEQ ID NO: 1218 - DNA, 1934 bp, Homo sapiens
  ref <308>: DATABASE ACCESSION NUMBER: NM_005928
  ref <309>: DATABASE ENTRY DATE: 2001-06-18
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagccccaggctggagataacagcctcttgcccgtcggccctgcgtcggccctggggtaccatgtgccacaactgctgtggccccctgtccccaagacacttccccttgtctccctggttgcctctcttgccccttgtcctgaagcccagcgacacagaagggggtggggcgggtctatggggagaaagggagcgaggtcagaggagccggcatgggttggcagggtgggcgtttggggccctcatgctggcttttcaccccagaggacacaggcagcttccaaaatatatttatcttcttcacggg

SEQ ID NO: 1219 - DNA, 2392 bp, Homo sapiens
  ref <308>: DATABASE ACCESSION NUMBER: NM_005932
  ref <309>: DATABASE ENTRY DATE: 2001-06-18
gcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgggcgcgtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaacaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatgctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccacttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctctaatcaaggtcatgtagtaatgactttgttataaatgctacagctgtgagagcttgtttctgattgtttcattgttcgcttctgtaattctgaaaaactttaaactggtagaacttggaataaataatttgttttaattaaaaaaaaaaaaaaaaaa

SEQ ID NO: 1220 - DNA, 9390 bp, Homo sapiens
  ref <308>: DATABASE ACCESSION NUMBER: NM_005935
  ref <309>: DATABASE ENTRY DATE: 2001-06-18
ggcaatttcttttcctttctaactgtggcccgcgttgtgctgttgctgggcaggcgttgggcgccggcggtcttcgagcgtgggggcccgctggctttcccttctcagaaactgcgccgggggcgctcgcttgccccggattcggacgcggcgctccccgggctcgtctgaagtgcagatcgccgcagaggccccagtgcccggatgtccatcaggattagcgcgagccaatacgggccgagcccggggctgcgccgaggacgcccggggctcgagagcaggtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacgtttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttaataacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctggacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagttcttctccagactgttctttggttgtcacttaagtcagaggtctggtccctcatgtttaggtgaaagccagagaatgacagctgtagtcatatctgagcataagaccttgatgtgtgattcctgatgaccggtttcatttattcatgtaataaagcaaaggccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtctaaatcttgcctttggcactacaaggtgtgtgtgtgtgtgtgtgttgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttggctgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaacggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaaggcaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggataatacctgagcagggttgccttttttttatttattaccattatatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatcaaaaaaaaaaa

SEQ ID NO: 1221 - DNA, 1416 bp, Homo sapiens; identical to SEQ ID NO: 405
  Modified_base 1 ... 1416: n = a,c,g, or t
  ref <308>: DATABASE ACCESSION NUMBER: NM_005945
  ref <309>: DATABASE ENTRY DATE: 2001-06-18

SEQ ID NO: 1222 - DNA, 186 bp, Homo sapiens
  ref <308>: DATABASE ACCESSION NUMBER: NM_005953
  ref <309>: DATABASE ENTRY DATE: 2001-06-18
atggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctga

SEQ ID NO: 1223 - DNA, 428 bp, Homo sapiens
  ref <308>: DATABASE ACCESSION NUMBER: NM_005978
  ref <309>: DATABASE ENTRY DATE: 2001-06-18
ctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttga

SEQ ID NO: 1224 - DNA, 4221 bp, Homo sapiens
  ref <308>: DATABASE ACCESSION NUMBER: NM_005990
  ref <309>: DATABASE ENTRY DATE: 2001-06-18
cagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacacaataaaagcaaatgtttgaaccagt

SEQ ID NO: 1225 - DNA, 802 bp, Homo sapiens
  ref <308>: DATABASE ACCESSION NUMBER: NM_006002
  ref <309>: DATABASE ENTRY DATE: 2001-06-18
ggagggccgggcaccgcggcatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgcccatacactaactcaaaaattttgatattttcc

SEQ ID NO: 1226 - DNA, 515 bp, Homo sapiens
  ref <308>: DATABASE ACCESSION NUMBER: NM_006004
  ref <309>: DATABASE ENTRY DATE: 2001-06-18
ggggggctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgattcctctcgatcacatacagaagaggattgcacggaggagctctttgacttcttgcatgcgagggaccattgcgtggcccacaaactctttaacaacttgaaataaatgtgtggacttaagttgcaccccagtcttcatcatctgggcatcagaatatttccttatggttttggatgtaccatttgtttcttatttgtgtaactgtaagttcacatcaacctcatgggtttggcttgaggctggtagcttctatgtaattcgcaatgattccatctaaataaaagttctatgatctgcaaaaaaaaaaa

SEQ ID NO: 1227 - DNA, 3640 bp, Homo sapiens
  ref <308>: DATABASE ACCESSION NUMBER: NM_006005
  ref <309>: DATABASE ENTRY DATE: 2001-06-18
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcggatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaatgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 1228 - DNA, 2197 bp, Homo sapiens
  ref <308>: DATABASE ACCESSION NUMBER: NM_006006
  ref <309>: DATABASE ENTRY DATE: 2001-06-18
caggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtgacaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaaaaaaaggaattc

SEQ ID NO: 1229 - DNA, 3794 bp, Homo sapiens
  ref <308>: DATABASE ACCESSION NUMBER: NM_006017
  ref <309>: DATABASE ENTRY DATE: 2001-06-18
ccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagccatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttgg

SEQ ID NO: 1230 - DNA, 2051 bp, Homo sapiens
  ref <308>: DATABASE ACCESSION NUMBER: NM_006018
  ref <309>: DATABASE ENTRY DATE: 2001-06-18
cgccactttgctggagcattcactaggcgaggcgctccatcggactcactagccgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaactttggggacatcccttgccggctggtgctcttcatgtttgccatgaaccgccagggcagcatcatcttcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggccctgcaaatgtgtgcatcagcttcagcatctgccataccttccggtggcacgaagctatgttcctcctggagttcctcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctcaaataaccattccaagaagggacattgtcaccaagaaccagcatctctggagaaacagttgggctgttgcatcgagtaatgtcactggactcggcctaaggtttcctggaacttccagattcagagaatctgatttagggaaactgtggcagatgagtgggagactggttgcaaggtgtgaccacaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggggggggctcagctcctcgggtgatatctagcctgcttgtgagctctagcagggataaggagagctgagattggagggaattgtgttgctcctggaggaagcccaggcatcattaaacaagccagtaggtcacctggcttccgtggaccaattcatctttcagacaagctttagagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgagcagttaaaacggcttcaggatagaaagctgtttcccacctgtttcgttttaccattaaaagggaaacgtgcctctgccccacgggtagagggggtgcacgttcctcctggttccttcgcttgtgtttctgtacttaccaaaaatctaccacttcaataaattttgataggagacaaaaaaaaaa

SEQ ID NO: 1231 - DNA, 1542 bp, Homo sapiens
  ref <308>: DATABASE ACCESSION NUMBER: NM_006023
  ref <309>: DATABASE ENTRY DATE: 2001-06-18
tgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaacctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactgggagggacgctcacaagctaatagacttccttaagctgaagagaaatcagcaggaggacgactgatgagcgtactgtaactggagaagaggaggccccgccccaccgctccgggagctgctcatcagccgcaacttcctgccgaccctgatgcgggtgggccgagcagtgtggacatcagccactttttatattcatgtacattcacctggggaaaaaaacggagggactttgctacttgtaaaaataacataataaatagatcttaaacataggaaaaccatactgttctgataataaaatgctttctatgaaat

SEQ ID NO: 1232 - DNA, 2912 bp, Homo sapiens
  ref <308>: DATABASE ACCESSION NUMBER: NM_006027
  ref <309>: DATABASE ENTRY DATE: 2001-06-18
tgcacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacttctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacatttgtatattaactttaaaaaaaaaaaaaaaaaa

SEQ ID NO: 1233 - DNA, 2136 bp, Homo sapiens
  Modified_base 1 ... 2136: n = a,c,g, or t
  ref <308>: DATABASE ACCESSION NUMBER: NM_006029
  ref <309>: DATABASE ENTRY DATE: 2001-06-18
cgaggagcgacggccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagaganctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggacgggacatcccagggcctggagaggaaactttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccnaacctctttcagttgctggtgcagatccgtgaggaggaagccaargaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgcccaggtaaagggttggttggacacagcgcttagtgcacgctgtcatcatggacatcataatcagttgtgaaaaacacgcgaacctatgacacttcttattccacactgaatgtgaaattgcatgttcagatgtttnactacgaggcctggctcacaggaagtgttcagtaaaagtatgcactgttagattactgataacgcggatagatttttgttwaccataaattgttccagatttatattaatggaaggaagtgtgcatttattagctattantcaactttacaakgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacttctttgtcagagaatagttcttgttcatactgagtgttctaaatttgaagttatatatacaaattaaaatattttaaaaaaaaaaaaaa

SEQ ID NO: 1234 - DNA, 3927 bp, Homo sapiens
  ref <308>: DATABASE ACCESSION NUMBER: NM_006033
  ref <309>: DATABASE ENTRY DATE: 2001-06-18
agcagcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgca

SEQ ID NO: 1235 - DNA, 1828 bp, Homo sapiens
  ref <308>: DATABASE ACCESSION NUMBER: NM_006051
  ref <309>: DATABASE ENTRY DATE: 2001-06-18
gctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtgacagggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctc

SEQ ID NO: 1236 - DNA, 4544 bp, Homo sapiens
  ref <308>: DATABASE ACCESSION NUMBER: NM_006055
  ref <309>: DATABASE ENTRY DATE: 2001-06-18
ccgagaagggcttcaggacgcgggaggcgcacttgcttcaagtcgcgggcgtgggaacggggttgcaaaacggggcctttttatccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcagcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactataaaaaaa

SEQ ID NO: 1237 - DNA, 2811 bp, Homo sapiens
  ref <308>: DATABASE ACCESSION NUMBER: NM_006074
  ref <309>: DATABASE ENTRY DATE: 2001-06-18
gaattcggcacgagctcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagatcgagagacagaagattctgaaagggttcaatgaaatgagagtcatcttggacaatgaggagcagagagagctgcaaaagctggaggaaggtgaggtgaatgtgctggacaacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgctccctgtcgtattggggttttcctagactatgaggcaggcattgtctcatttttcaatgtcacaaaccacggacgactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttctgtgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctgaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggcctcagggcccaccgctaatgccttaatgaaatcattttaacattatattgtgtacaaagaccttatttccaaataagataatatttggaggtattgggaataaaatttgaggaaggcgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtcataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctctaaaaaaaaaa

SEQ ID NO: 1238 - DNA, 1648 bp, Homo sapiens
  ref <308>: DATABASE ACCESSION NUMBER: NM_006086
  ref <309>: DATABASE ENTRY DATE: 2001-06-18
atgcgggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggggggacgggctccggcatgggcacgttgctcatcagcaaggtgcgtgaggagtatcccgaccgcatcatgaacaccttcagcgtcgtgccctcacccaaggtgtcagacacggtggtggaaccctacaacgccacgctgtccatccaccagctggtggaaaacacggatgaaacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcaccaggcggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaaactgctcgcagctggagtgagaggcaggtggcggccggggccgaagccagcagtgtctaaacccccggagccatcttgctgccgacaccctgctttccccatcgccctagggctcccttgccgccctcctgcagtatttatggcctcgtcctcccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 1239 - DNA, 1335 bp, Homo sapiens
  ref <308>: DATABASE ACCESSION NUMBER: NM_006087
  ref <309>: DATABASE ENTRY DATE: 2001-06-18
atgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtgggacggggtccggaatgggcacgctgctcatcagtaagatgcgcgaggagttcccagaccgcatcatgaacaccttcagcgtggtgccctcgcccaaagtgtcagacacggtggtggagccctacaatgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccgcgttcgcacccctgaccagccggggcagccagcagtaccggggcctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgtgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgagcagggcgagttcgaggaggaggcggaggaggaggtggcctag

SEQ ID NO: 1240 - DNA, 3020 bp, Homo sapiens
  ref <308>: DATABASE ACCESSION NUMBER: NM_006096
  ref <309>: DATABASE ENTRY DATE: 2001-06-18
tgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacaccctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagctttccggaaacaaaatccttttcttcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcaacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggtccaggaattttgagagattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatggactttccttccctctcctgcttcctcttttcctgctccctaacctttcgccgaatggggcagacaaacactgacgtttctgggtggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtgggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaaaaaaaaaaaaaaaaa

SEQ ID NO: 1241 - DNA, 2150 bp, Homo sapiens
  ref <308>: DATABASE ACCESSION NUMBER: NM_006101
  ref <309>: DATABASE ENTRY DATE: 2001-06-18
ctcgagccacgaaggccccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaaaaaaaaaaaaaaaaaaaaaaaaaaaaaaaaaaaaaaaaaaaaaaaaaaaaaaaaaaaaaaa

SEQ ID NO: 1242 - DNA, 583 bp, Homo sapiens
  ref <308>: DATABASE ACCESSION NUMBER: NM_006103
  ref <309>: DATABASE ENTRY DATE: 2001-06-18
cccctgcaccccgcccggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgccttctctgccccaatgataaggagggttcctgcccccaggtgaacattaactttccccagctcggcctctgtcgggaccagtgccaggtggacacgcagtgtcctggccagatgaaatgctgccgcaatggctgtgggaaggtgtcctgtgtcactcccaatttctgaggtccagccaccaccaggctgagcagtgaggagagaaagtttctgcctggccctgcatctggttccagcccacctgccctcccctttttcgggactctgtattccctcttggggtgaccacagcttctccctttcccaaccaataaagtaaccactttcagcaaaaaaaaaaaaaaaa

SEQ ID NO: 1243 - DNA, 1584 bp, Homo sapiens
  ref <308>: DATABASE ACCESSION NUMBER: NM_006111
  ref <309>: DATABASE ENTRY DATE: 2001-06-18
gcgtcccccacaccacagacccgcgccgccgacgacccagcagccgccatgcgtctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttactgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttc

SEQ ID NO: 1244 - DNA, 4772 bp, Homo sapiens
  ref <308>: DATABASE ACCESSION NUMBER: NM_006113
  ref <309>: DATABASE ENTRY DATE: 2001-06-18
atccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggagaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaaatatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagtcaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggagagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaggggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctrgcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagcccttgtgtaatatggtgaattagagtggtatttcactttgtattattttgtaaatatgtcaatataataaatagtgactaaaaaaaaaaaaaa

SEQ ID NO: 1245 - DNA, 2148 bp, Homo sapiens
  ref <308>: DATABASE ACCESSION NUMBER: NM_006115
  ref <309>: DATABASE ENTRY DATE: 2001-06-18
gcttcagggtacagctcccccgcagccagaagccgggcctgcagcccctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 1246 - DNA, 1348 bp, Homo sapiens
  ref <308>: DATABASE ACCESSION NUMBER: NM_006117
  ref <309>: DATABASE ENTRY DATE: 2001-06-18
caggtggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaac

SEQ ID NO: 1247 - DNA, 1450 bp, Homo sapiens
  ref <308>: DATABASE ACCESSION NUMBER: NM_006142
  ref <309>: DATABASE ENTRY DATE: 2001-06-18
ccaggcagcagttagcccgccgcccgcctgtgtgtccccagagccatggagagagccagtctgatccagaaggccaagctggcagagcaggccgaacgctatgaggacatggcagccttcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtccccgccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctcttgattcgtaggaattgaggagtgtctccgccttgtggctgagaactggacagtggcaggggctggagatgggtgtgtgtgtgtgtgtgtgtgtgtgtgtgtgcgcgcgcgccagtgcaagaccgagactgagggaaagcatgtctgctgggtgtgaccatgtttcctctcaataaagttcccctgtgacactcaaaaaaaaaaaaaaaaaaaaaaaaaaaaaaaaaaaaaaaaaaa

SEQ ID NO: 1248 - DNA, 878 bp, Homo sapiens
  ref <308>: DATABASE ACCESSION NUMBER: NM_006144
  ref <309>: DATABASE ENTRY DATE: 2001-06-18
cagattttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaa

SEQ ID NO: 1249 - DNA, 3846 bp, Homo sapiens
  ref <308>: DATABASE ACCESSION NUMBER: NM_006148
  ref <309>: DATABASE ENTRY DATE: 2001-06-18
gcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaatataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccggagcgcccccatctgtcttcagcacattccacggcatcgcatccgtcctgggcgtgagccgtccattcttcagtgtctctgttttttaaaacctgcgacagcttgtgattcctacccctcttccagcttcttttgccaactgaagccttcttctgccacttctgcgggctccctcctctggcaggcttcccccgtgatcgacttcttggttttctctctggatggaacgggtatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgtcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtgggccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataattttta

SEQ ID NO: 1250 - DNA, 1414 bp, Homo sapiens
  ref <308>: DATABASE ACCESSION NUMBER: NM_006153
  ref <309>: DATABASE ENTRY DATE: 2001-06-18
ggaattccggaattccgcggagcaggcctcgtgccgttacggccatcacggccgccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaattgaagactgagaaaatgttgggtccagtcgtgcttgattggaaattgttgtttctaaatctatatgagatttgacatagtattttattatactcagccatacatatatactatgtatgagcagtg

SEQ ID NO: 1251 - DNA, 3198 bp, Homo sapiens
  ref <308>: DATABASE ACCESSION NUMBER: NM_006159
  ref <309>: DATABASE ENTRY DATE: 2001-06-18
ttgggaggagcagtctctccgctcgtctcccggagctttctccattgtctctgcctttacaacagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttacctt

SEQ ID NO: 1252 - DNA, 2568 bp, Homo sapiens
  ref <308>: DATABASE ACCESSION NUMBER: NM_006170
  ref <309>: DATABASE ENTRY DATE: 2001-06-18
atggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccatcgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttcgcagagcagccttttgagaaagctgccttccagaaacagaatgatacccccaagggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactga

SEQ ID NO: 1253 - DNA, 6577 bp, Homo sapiens
  ref <308>: DATABASE ACCESSION NUMBER: NM_006197
  ref <309>: DATABASE ENTRY DATE: 2001-06-18
tgccgcttccgcggtcacatgactccagtctagctcgcattgcgctcccgccggcgagttctccccgcgcgccgttgcgaggagacggcgcatgtccgccgcgcttgcccctctgcagtaccccgccctcttctccaccacaatgagatctaagtgcgtgctgcgcgtgcgtacgtgaggtcgaaaagcgcactgggacggcagccaggaaacgtgtgggcctctctgctgcggtctccgagggccgaccgctgccggcgcgggtcgtgcgggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagaggagctctacagggacggcaggctgcacttctagctctgcaacataaagcagacgaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttgtctaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcacgagaaaattcaagcattgcaaacggcatgccctgacttacagctgtcagctgctagtgtgggtaactgtcctaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatccagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccaacgaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagccagaattctttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctcttcaagcaaaagtattcagcagaaagaatcatgagcaactggaaaaaataataaaatgtaataggtctacagaaatatcttcagaaactgggagtgatttttccatgtttgaagctttgcaggatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtccattggaacgagaagccactagtaaaaatgaccaaaaataactgtcctgtgaaacccagttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatgtgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatct

SEQ ID NO: 1254 - DNA, 1745 bp, Homo sapiens
  ref <308>: DATABASE ACCESSION NUMBER: NM_006201
  ref <309>: DATABASE ENTRY DATE: 2001-06-18
tggaagcagcgtaaaggatggacaggaatgcagaggtaggcaggaggaccagcagtgtgactgctgaaacccaggggagggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcc

SEQ ID NO: 1255 - DNA, 1368 bp, Homo sapiens
  ref <308>: DATABASE ACCESSION NUMBER: NM_006224
  ref <309>: DATABASE ENTRY DATE: 2001-06-18
ccgcagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtc

SEQ ID NO: 1256 - DNA, 1750 bp, Homo sapiens
  ref <308>: DATABASE ACCESSION NUMBER: NM_006227
  ref <309>: DATABASE ENTRY DATE: 2001-06-18
gtggccgccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 1257 - DNA, 3314 bp, Homo sapiens
  ref <308>: DATABASE ACCESSION NUMBER: NM_006235
  ref <309>: DATABASE ENTRY DATE: 2001-06-18
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttggcctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccggcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactactctttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctctctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcgcgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaaaaaaaaaaaa

SEQ ID NO: 1258 - DNA, 3120 bp, Homo sapiens
  ref <308>: DATABASE ACCESSION NUMBER: NM_006243
  ref <309>: DATABASE ENTRY DATE: 2001-06-18
ccgcagagggccggggctacggggcagccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccaccgtctgcgcgcccagagtcaacaacttcttcacccccctccgcccccgcccttccctccgtcagccccgggagctcgccgcggcccggggaccaggaacctccagcgctgagatgtggccgtgaggcgttggcgggcgccgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttg

SEQ ID NO: 1259 - DNA, 8062 bp, Homo sapiens
  ref <308>: DATABASE ACCESSION NUMBER: NM_006264
  ref <309>: DATABASE ENTRY DATE: 2001-06-18
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 1260 - DNA, 3647 bp, Homo sapiens
  ref <308>: DATABASE ACCESSION NUMBER: NM_006265
  ref <309>: DATABASE ENTRY DATE: 2001-06-18
agtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgt

SEQ ID NO: 1261 - DNA, 607 bp, Homo sapiens
  ref <308>: DATABASE ACCESSION NUMBER: NM_006271
  ref <309>: DATABASE ENTRY DATE: 2001-06-18
ggactgttgaagacaggtctccacacacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccttgcccaccccacccccacccccaccaagggcgcaagagtagcggtccaagcctgcaactcatctttcattaaaggcttctctctcaccagcaaaaaaaaaaaaa

SEQ ID NO: 1262 - DNA, 687 bp, Homo sapiens
  ref <308>: DATABASE ACCESSION NUMBER: NM_006274
  ref <309>: DATABASE ENTRY DATE: 2001-06-18
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaactaattg

SEQ ID NO: 1263 - DNA, 2820 bp, Homo sapiens
  ref <308>: DATABASE ACCESSION NUMBER: NM_006281
  ref <309>: DATABASE ENTRY DATE: 2001-06-18
ccgcggagttacgggaaagttggtccgagttcccagagtttccctctgtggtgccctaggcttcggcccggtgccccggctcctttcctcctttcggccttcgccgtccaccaggtccctctctctgtcccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgacgaacagcaacgagaattggaagaggaagaagaaaattcggatgaagatgagctggattcccacaccatggtgaagactagtgtgggagagtgtggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaaggctattgttgcattgtacagcactgaaagggctttatgttacaatattctttattcctatctagtatactaggctatttattgtccccttaggtaaacttatttatttatgctattttggctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccac

SEQ ID NO: 1264 - DNA, 915 bp, Homo sapiens
  ref <308>: DATABASE ACCESSION NUMBER: NM_006287
  ref <309>: DATABASE ENTRY DATE: 2001-06-18
atgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtga

SEQ ID NO: 1265 - DNA, 4426 bp, Homo sapiens
  ref <308>: DATABASE ACCESSION NUMBER: NM_006290
  ref <309>: DATABASE ENTRY DATE: 2001-06-18
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttcctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattattt

SEQ ID NO: 1266 - DNA, 4180 bp, Homo sapiens
  ref <308>: DATABASE ACCESSION NUMBER: NM_006291
  ref <309>: DATABASE ENTRY DATE: 2001-06-18
ccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacctggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatatttttgtggatacagggtctcattctgttgcctaggcttgtctggaactcctgggctcaagggatcttgtagccttagcctcctaaagtgctgggattataggcatgagtcactcgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcgatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtgaaaaa

SEQ ID NO: 1267 - DNA, 1833 bp, Homo sapiens
  ref <308>: DATABASE ACCESSION NUMBER: NM_006296
  ref <309>: DATABASE ENTRY DATE: 2001-06-18
ctgcactgcgaggccgacgcagctggagagaagttaggcaggtcctagggagggcaggctcgagtgctgggcccgcctccccgcgggactgtaggcccgggggctccgcctcgtcgcagcggcagaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatgtaaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagtttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagt

SEQ ID NO: 1268 - DNA, 509 bp, Homo sapiens
  ref <308>: DATABASE ACCESSION NUMBER: NM_006304
  ref <309>: DATABASE ENTRY DATE: 2001-06-18
attctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaa

SEQ ID NO: 1269 - DNA, 2530 bp, Homo sapiens
  ref <308>: DATABASE ACCESSION NUMBER: NM_006314
  ref <309>: DATABASE ENTRY DATE: 2001-06-18
aaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtcccccaactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaaaaaaaaaaaaaaa

SEQ ID NO: 1270 - DNA, 1032 bp, Homo sapiens
  ref <308>: DATABASE ACCESSION NUMBER: NM_006332
  ref <309>: DATABASE ENTRY DATE: 2001-06-18
ggagggtgggcagcactcgctttattgtccagcattccacatggatagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgtcggtgccctacggaaacgcacaggaacaaaatgtcagtggcaggtgggagttcaagtgccagcttggagaagaggagtgcaaattcaacaaggtggaggcctgcgtgttggatgaacttgacatggagctagccttcctgaccatgtctggcatggcatggaagagtttgaggacatggagagaagtctgccactatgcctgcagctctacgccccagggctgtcgccagaactatcatggagtgtgcaatgggggaccgcggcatgcagctcatgcacgccaacgcccagcggacagatgctctccagccaccgcacgagtatgtgccctgggtcaccgtcaatgggaaacccttggaagatcagacccagctccttacccttgtctgccagttgtaccagggcaagaagccggatgtctgcccttcctcaaccagctccctccggagtgtttgcttcgagtgttggccggtgggctgcggagagctcatggaaggcgagtgggaactcggctgcctgcctttttttctgatccagaccctcggcacctgctacttaccaactggaaaattttatgcatcccatgaagcccagatacacaaaattccacccctagatcaagaatcctgctccactaagaatggtgctaaagtaaaactagtttaat

SEQ ID NO: 1271 - DNA, 1294 bp, Homo sapiens
  ref <308>: DATABASE ACCESSION NUMBER: NM_006357
  ref <309>: DATABASE ENTRY DATE: 2001-06-18
cccacagctgcctccatttccttaaggaagggtttttttctctctccctcccccacaccgtagcggcgcgcgagcggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggaaaaaaaaaaaaaaaa

SEQ ID NO: 1272 - DNA, 1517 bp, Homo sapiens
  ref <308>: DATABASE ACCESSION NUMBER: NM_006366
  ref <309>: DATABASE ENTRY DATE: 2001-06-18
attctttggggaggcaactaggatggtgtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaagaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaa

SEQ ID NO: 1273 - DNA, 2221 bp, Homo sapiens
  ref <308>: DATABASE ACCESSION NUMBER: NM_006372
  ref <309>: DATABASE ENTRY DATE: 2001-06-18
cgcgggggcgggcgcgcaccgggagcgcgtcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagccaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatcaaaaaaaaaaaaaaaaaa

SEQ ID NO: 1274 - DNA, 6330 bp, Homo sapiens
  ref <308>: DATABASE ACCESSION NUMBER: NM_006377
  ref <309>: DATABASE ENTRY DATE: 2001-06-18
agtcccagcctgccggccggtactcaccgctacccggagttcgctcagacggtgagatttggggcgggtccgaggcagcggcgggacgtacctgcgaccgggaccatgaggagctgccagacccgtggggccggtaacgagagcagtcgcggcacctgctgagaggaaagagggagcggtcccgcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaagtggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagccgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagaggtttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttactcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaagaggttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggcctgaacaaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcaaaaaaaaaaaaaaaaaaaaaaaaaaaaa

SEQ ID NO: 1275 - DNA, 4157 bp, Homo sapiens
  ref <308>: DATABASE ACCESSION NUMBER: NM_006378
  ref <309>: DATABASE ENTRY DATE: 2001-06-18
ctgagccgcatctgcaatagcacacttgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttaaaaaaaaaaaaaa

SEQ ID NO: 1276 - DNA, 1231 bp, Homo sapiens
  ref <308>: DATABASE ACCESSION NUMBER: NM_006383
  ref <309>: DATABASE ENTRY DATE: 2001-06-18
gccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggatggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtggcgccaagggctcttgctcctgtctctgcctctgggtcatgagtaccaccctgcctgcctccccaacaccgtggaatcctcactggtgtgctgtccacagatttgtgaactcctggtagtaaaacacttttgcatcca

SEQ ID NO: 1277 - DNA, 4552 bp, Homo sapiens
  ref <308>: DATABASE ACCESSION NUMBER: NM_006389
  ref <309>: DATABASE ENTRY DATE: 2001-06-18
agcgcccgccgcgtccggggccggctggtgcgcgagacgccgccgagagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatgcagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctac

SEQ ID NO: 1278 - DNA, 8034 bp, Homo sapiens
  ref <308>: DATABASE ACCESSION NUMBER: NM_006393
  ref <309>: DATABASE ENTRY DATE: 2001-06-18
cttgagtgttagagctgagtagttttcccagaatctctaagtcctttttatgctcttttatgaatgaatagaattagtaaaagataaataaattttttcttttggatttcttaaccagtggaaaaaatgttgactttaaaagttcataaaatcaaattttgcttaagaatatgttatttccacttgtgaggccagcctggtagacctctgggatccttttctgttcactcacacaccactgagataaggagtgaagtgtgggctaaatagggctgaggcttgggcaagggcatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaattcgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgggcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactctgtaatgcagccaataatacaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagtttggaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtgtcttcttttggaaaatggtattcaaattctggaatggaaatctagccaccaaaacgggttaatcaaaagacgtccttttccgttttttttgcttttattttctaaatcatttttaagggaatgaaacaggaatgtcatcagagattttttagtacaggcccaagagcctgtactctaagaaagaaatttttgccatgtatgaattttcgaataagtgactttgcaggcttttgctagcccttgctggtgggtctggaaattacatccagagtctgcagtccaggtcaccaagccagcggcacccgtcggcaaccctgtgtttaacggattgtgccgtttactgtgacctgcaacggggtggcattcacttagggtctgacttcacagctatgacaaaaccgaaaaagcaaaactgcgaggaagtgctaagatgtacgggtcttggggatatctgccttatatgttatattcaaggaaattaacgaaacatcctgtgaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggtttctctcactgaaatggccagtcgtgattaaagtgataaaaccccatatctgttttggtatattgtacacaaacctacaaaaataaactgaacttgcaatatttttgcaataaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcagatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgcgcttaggccataatttggtagtgttggcagttgttaataaagcttgtcaggatgttaagcatctcaggagaaatattggaaaattatatgtataaaaccaaagtgctgtttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttacaaatgaaggggcttcacggaatgttacaatgttactaatataatttggcttttgttatgcaaattgttaacaccagctattaaaatatattttagtagaaaaaaaaaaa

SEQ ID NO: 1279 - DNA, 777 bp, Homo sapiens
  ref <308>: DATABASE ACCESSION NUMBER: NM_006398
  ref <309>: DATABASE ENTRY DATE: 2001-06-18
ggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattc

SEQ ID NO: 1280 - DNA, 921 bp, Homo sapiens
  ref <308>: DATABASE ACCESSION NUMBER: NM_006406
  ref <309>: DATABASE ENTRY DATE: 2001-06-18
gcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 1281 - DNA, 1077 bp, Homo sapiens
  ref <308>: DATABASE ACCESSION NUMBER: NM_006408
  ref <309>: DATABASE ENTRY DATE: 2001-06-18
accgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacatgttttagaaatttggtttcaagtgtacatgtgtgaaaacaatattgtatactaccatagtgagccatgattttctaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaaaaaaaaaaaaaaaa

SEQ ID NO: 1282 - DNA, 1050 bp, Homo sapiens
  ref <308>: DATABASE ACCESSION NUMBER: NM_006410
  ref <309>: DATABASE ENTRY DATE: 2001-06-18
gtcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattgggcggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagctctttggctccttaccagactcttgggccagggggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggagaaataaagatttgtcagcccaa

SEQ ID NO: 1283 - DNA, 991 bp, Homo sapiens
  ref <308>: DATABASE ACCESSION NUMBER: NM_006414
  ref <309>: DATABASE ENTRY DATE: 2001-06-18
aacggattcgccatcgtgagttccaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgataatctgaaggagaagaaaacagatgctaagcagcaagtgtcagggtggacgcctgcacacgtcaggaagcagcttgtcattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacataaaaaaaaaaaaaaa

SEQ ID NO: 1284 - DNA, 1335 bp, Homo sapiens
  ref <308>: DATABASE ACCESSION NUMBER: NM_006417
  ref <309>: DATABASE ENTRY DATE: 2001-06-18
atggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctcctcctgggtccaattggagctcccaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcaaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatag

SEQ ID NO: 1285 - DNA, 1883 bp, Homo sapiens
  ref <308>: DATABASE ACCESSION NUMBER: NM_006430
  ref <309>: DATABASE ENTRY DATE: 2001-06-18
atgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctagcattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgta

SEQ ID NO: 1286 - DNA, 3624 bp, Homo sapiens
  ref <308>: DATABASE ACCESSION NUMBER: NM_006460
  ref <309>: DATABASE ENTRY DATE: 2001-06-18
gcaggttgggagggaaagtcgggggaggacgcggaagaggagctgtgggaagggggaggagggagggaggaaaagaggaggagacggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagcgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagcttttctttggtctaaaaattatattaaacatttattttgaaaaaaaaaaaaaaaaaaaaaaaaaaa

SEQ ID NO: 1287 - DNA, 3791 bp, Homo sapiens
  ref <308>: DATABASE ACCESSION NUMBER: NM_006461
  ref <309>: DATABASE ENTRY DATE: 2001-06-18
acagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccacctctggaaaaagatcccccgcttgctcctcgctgaccccatcactgtgcaagctggggctgcaggaaggcagcaacaactcgtctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattgtggagtttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgaatcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacattcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatgcgtaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagaatgagaagatcctagaacagatagacaagagtggcgagctcataagccttagagaggaggtgacccaccttacccgctcacttcggcgtgcggagacagagaccaaagtgctccaggaggcctggcaggccagctggactccaactgccagcctatggccaccaattggatccaggagaaagtgtggctctctcaggaggtggacaaactgagagtgatgttcctggagatgaaaaatgagaaggaaaactcctgatcaagttccagagcccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatttgtttcacctctttttacctgcaatacccccttaccccaataccaagaccaactggcatagagccaactgagataaatgctatttaaataaagtgtatttaatgaaaaaaaaaaaaaaaaaaaaa

SEQ ID NO: 1288 - DNA, 2752 bp, Homo sapiens
  ref <308>: DATABASE ACCESSION NUMBER: NM_006469
  ref <309>: DATABASE ENTRY DATE: 2001-06-18
agtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttctgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaagagctgaagatggatcgagtaaagcaggtttgtggtgattatttactgtctagaatggatgttaccagctgcatctcttaccgaaattttgcaagttgtatgggagactcccatttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggacatatgacttcaccaaggagcaatgctgggattgcaactgtagggaacaccatttatgcagtggaggattcgatggcaatgaatttctgaatacggcggaagtctataaccttgagtcaaatgaatggagcccctatacaaagattttccagttttaacgggtttaagaccctctcaaactaacaggcttagtgatgtaattatggttagcagaggtacacttgtgaataaagagggtgggtggggatagatgttgctaacagcaacacaaagcttttgcatattgcatactattaaacatgctgtacatactttttgggtttatttgggaaggaatgcaaagatgaaggtctgtttgtgtacttttaagactttggttattttactttttggaaaagataaaccaagaattgattgggcacatcaaaaaaaaaaaaaaaaaaaa

SEQ ID NO: 1289 - DNA, 2568 bp, Homo sapiens
  ref <308>: DATABASE ACCESSION NUMBER: NM_006470
  ref <309>: DATABASE ENTRY DATE: 2001-06-18
gctgtcctgagcctgagtactctagctgccttgtcgccatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgctttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgcccttcttagaggagaaggagcaagctgcgctgaaccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaattttgcctgcaaattttcagaaccagtctatgctgccttctggctttccaagaaggaaagcgccatccggattgtagatctgggagaggaacccgagaagccagcaccgtccttggtggtgactgctccctagactccaggagccatatcccagacctttgccagctacagtgatgggatttgcattttagggtgatttgtgggcagaaataactgctgatggtagctggcttttgaaatcctatggggtctctgaatgaaaacattctccagctgctctcttttgctccatatggtgctgttctctatgtgtttgcagtaattcttttttttttttgagacggagtctcgcactgttgcccaggctggagagcagtggcgcgatctcggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccagggaccttaaagagtggctgaaaagattgcagagttatcataataaattgctaacttgcgt

SEQ ID NO: 1290 - DNA, 968 bp, Homo sapiens
  ref <308>: DATABASE ACCESSION NUMBER: NM_006491
  ref <309>: DATABASE ENTRY DATE: 2001-06-18
gaattccgacaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcagaagcataatatctcctggatatcatgaagcaagatataagagaagaacaaaacaaaatccgtaattcattgaaagaattgtaatcatcaatctttcatattattaatactttgtaattattttctccccaacagtattttccagtagattctaatcatgtggtagggcagaaggaaatgtgttttttgttgttcatttgtttcttgtcaatagtcctgattattttagctttgctatactgacttatatctggaagtatataaccaagataagaaaataggttttaatatgatcatcttaagctaattgtaatgaaaagaactaatggactgtcaatattcagaaaaccaaaaataaaaaatacggaaaactaaaaaaaacccgaattc

SEQ ID NO: 1291 - DNA, 1347 bp, Homo sapiens
  ref <308>: DATABASE ACCESSION NUMBER: NM_006495
  ref <309>: DATABASE ENTRY DATE: 2001-06-18
atggatcccaaatatttcatcttaattttgttttgtggacacctgaacaatacatttttttcaaagacagagacaattacaacagagaagcagtcacagcctaccttatacacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataa

SEQ ID NO: 1292 - DNA, 3583 bp, Homo sapiens
  ref <308>: DATABASE ACCESSION NUMBER: NM_006500
  ref <309>: DATABASE ENTRY DATE: 2001-06-18
acttgcgtctcgccctccggccaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcaggcctggaacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacagaccaggtgctggaaagggggcctgtgcttcagttgcatgacctgaaacgggaggcaggaggcggctatcgctgcgtggcgtctgtgcccagcatacccggcctgaaccgcacacagctggtcaagctggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagaccgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcacctgcacaccccctttcagagggccactgggttaggacctgaggacctcacttggccctgcaagccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcggcatccagaagcagctgcagtgttgctgccaccaccctcctgctcgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtacctgcggtgaggaagctgggcgctgttttcgagttcaggtgaattagcctcaatccccgtgttcacttgctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacggggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaaatcatacattgcttttttattctacatgggtaccacaggaacctgggggcctgtgaaactacaaccaaaaggcacacaaaaccgtttccagttggcagcagagatcaggggttacctctgcttctgagcaaatggctcaagctctaccagagcagacagctaccctacttttcagcagcaaaacgtcccgtatgacgcagcacgaagggcctggcaggctgttagcaggagctatgtcccttcctatcgtttccgtccactt

SEQ ID NO: 1293 - DNA, 2314 bp, Homo sapiens
  ref <308>: DATABASE ACCESSION NUMBER: NM_006509
  ref <309>: DATABASE ENTRY DATE: 2001-06-18
ggaattcccgcccggcccggccccgcgccccgcagccccgggcgccgcgcgtcctgcccggcctgcggcccagcccttgcgccgctcgtccgacccgcgatcgtccaccagaccgtgcctcccggccgcccgggccccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgccgttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaaggcgaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgacttgaaggtggggggtaggttggttgttcagagtcttcccaataaagatgagtttttgagcctcaaaaaaaaaaaaaggaattcc

SEQ ID NO: 1294 - DNA, 2856 bp, Homo sapiens
  ref <308>: DATABASE ACCESSION NUMBER: NM_006516
  ref <309>: DATABASE ENTRY DATE: 2001-06-18
tagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggctgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcctttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgataagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatcgcattattttgaatgtgaagggaa

SEQ ID NO: 1295 - DNA, 538 bp, Homo sapiens
  ref <308>: DATABASE ACCESSION NUMBER: NM_006533
  ref <309>: DATABASE ENTRY DATE: 2001-06-18
agggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgcaaac

SEQ ID NO: 1296 - DNA, 444 bp, Homo sapiens
  ref <308>: DATABASE ACCESSION NUMBER: NM_006551
  ref <309>: DATABASE ENTRY DATE: 2001-06-18
aattctagaagtccaaatcactcattgtttgtgaaagctgagctcacagcaaaacaagccaccatgaagctgtcggtgtgtctcctgctggtcacgctggccctctgctgctaccaggccaatgccgagttctgcccagctcttgtttctgagctgttagacttcttcttcattagtgaacctctgttcaagttaagtcttgccaaatttgatgcccctccggaagctgttgcagccaagttaggagtgaagagatgcacggatcagatgtcccttcagaaacgaagcctcattgcggaagtcctggtgaaaatattgaagaaatgtagtgtgtgacatgtaaaaactttcatcctggtttccactgtctttcaatgacaccctgatcttcactgcagaatgtaaaggtttcaacgtcttgctttaataaatcacttgctctac

SEQ ID NO: 1297 - DNA, 1002 bp, Homo sapiens
  ref <308>: DATABASE ACCESSION NUMBER: NM_006556
  ref <309>: DATABASE ENTRY DATE: 2001-06-18
ccgcgatctagaactagtcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcac

SEQ ID NO: 1298 - DNA, 1963 bp, Homo sapiens
  ref <308>: DATABASE ACCESSION NUMBER: NM_006558
  ref <309>: DATABASE ENTRY DATE: 2001-06-18
gcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaagaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaaaaaaaa

SEQ ID NO: 1299 - DNA, 1953 bp, Homo sapiens
  ref <308>: DATABASE ACCESSION NUMBER: NM_006564
  ref <309>: DATABASE ENTRY DATE: 2001-06-18
gcagaccttgcttcatgagcaagctcatctctggaacaaactggcaaagcatctctgctggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactgttaaagtctccaaact

SEQ ID NO: 1300 - DNA, 858 bp, Homo sapiens
  ref <308>: DATABASE ACCESSION NUMBER: NM_006573
  ref <309>: DATABASE ENTRY DATE: 2001-06-18
atggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcttggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtga

SEQ ID NO: 1301 - DNA, 576 bp, Homo sapiens
  ref <308>: DATABASE ACCESSION NUMBER: NM_006607
  ref <309>: DATABASE ENTRY DATE: 2001-06-18
atggctactctgatctacgttgataaggaaattggagaaccaggcacccgtgtggctgccaaggatgtgctgaagctggagtctagaccttcaatcaaagcattagatgggatatctcaagttttaacaccacgttttggcaaaacatacgatgctccatcagccttacctaaagctaccagaaaggctttgggcactgtcaacagagctacagaaaagtcagtaaagaccaatggacccagaaaacaaaaacagccaagcttttctgccaaaaagatgaccgagaagactgttaaaacaaaaagttctgttcctgcctcagatgacgcctatccagaaatagaaaaattctttcccttcaatcttctagactttgagagttttgacctgcctgaagagcgccagattgcacacctccccttgagtggagtgcctctcatgatccttgatgaggagggagagcttgaaaagctgtttcagctgggccccccttcacctgtgaaaatgccctctccaccatgggaatgcaatctgtttgcagtctccttcaagcattctgtcgaccctggatgttga

SEQ ID NO: 1302 - DNA, 2972 bp, Homo sapiens
  ref <308>: DATABASE ACCESSION NUMBER: NM_006622
  ref <309>: DATABASE ENTRY DATE: 2001-06-18
gcgcgcggctccgatgggaagcatgacccgggtggcgggacaagacttgcttcccggccacgcgcgctcggccggccgtggggcggggcataggcgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggarcttttgcggactatcacctaccagccagccgccagcaccaaaatgtgcgagcaggcgctgggcaagggttgcggaggggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccytggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaacccagaaccaggctaaggcatacagttcttgactttggacaatcccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaaaaaaaaaaaaaaa

SEQ ID NO: 1303 - DNA, 2478 bp, Homo sapiens
  ref <308>: DATABASE ACCESSION NUMBER: NM_006623
  ref <309>: DATABASE ENTRY DATE: 2001-06-18
cacctttccgcgggccgcggggatggcggcgcagggcgtagggcctgggccggggtcggcggcgcccccggggctggaggcggcccggcagaagctggcgctgcggcggaagaaggtgctgagcaccgaaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcaaactcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagagggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaaaaaaaaaaa

SEQ ID NO: 1304 - DNA, 2154 bp, Homo sapiens
  ref <308>: DATABASE ACCESSION NUMBER: NM_006636
  ref <309>: DATABASE ENTRY DATE: 2001-06-18
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccagaccttttgagttcaactgatcaaaccaaaggaaaagtgttgctagagaaaattggggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggta

SEQ ID NO: 1305 - DNA, 2053 bp, Homo sapiens
  ref <308>: DATABASE ACCESSION NUMBER: NM_006670
  ref <309>: DATABASE ENTRY DATE: 2001-06-18
ccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaaataaagattcttaaaagaa

SEQ ID NO: 1306 - DNA, 817 bp, Homo sapiens
  ref <308>: DATABASE ACCESSION NUMBER: NM_006681
  ref <309>: DATABASE ENTRY DATE: 2001-06-18
agtcctgcgtccgggccccgaggcgcagcagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaa

SEQ ID NO: 1307 - DNA, 1496 bp, Homo sapiens
  ref <308>: DATABASE ACCESSION NUMBER: NM_006682
  ref <309>: DATABASE ENTRY DATE: 2001-06-18
cgcactccctgctgggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgtttgacatcctttgagatattttattactaaaatctgcc

SEQ ID NO: 1308 - DNA, 3154 bp, Homo sapiens
  ref <308>: DATABASE ACCESSION NUMBER: NM_006696
  ref <309>: DATABASE ENTRY DATE: 2001-06-18
cgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccacgctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 1309 - DNA, 2031 bp, Homo sapiens
  ref <308>: DATABASE ACCESSION NUMBER: NM_006698
  ref <309>: DATABASE ENTRY DATE: 2001-06-18
ggcacgagggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaactttaaaaaaaaaaaaaaaaaa

SEQ ID NO: 1310 - DNA, 1078 bp, Homo sapiens
  ref <308>: DATABASE ACCESSION NUMBER: NM_006705
  ref <309>: DATABASE ENTRY DATE: 2001-06-18
cactcgctggtggtgggtgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagtttcaggagcgtgaaggacttaaccgactgccgctgctttttcaaaacggatccgggcaatgcttcgttttctaaaggatgctgctgttgaagctttgaattttacaataaactttttgaaacaaaaaaaaaaaaaaa

SEQ ID NO: 1311 - DNA, 2525 bp, Homo sapiens
  ref <308>: DATABASE ACCESSION NUMBER: NM_006739
  ref <309>: DATABASE ENTRY DATE: 2001-06-18
ttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctggacgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggtgagggatgtgatgctggccaagcatgtcatcactctgcacgtgagtgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggacggggcccgtcagcacgagagggacagtgaccgcgtccagcatccccatcactgtgcggcagttggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgctcactggactcatggactcgccacgctcgccctccttgccgctgcctgccattgacaatgttgctgggacctctgcctccccactgcagccctcgaacttcccaggcaccctcctttctgccccagaggaaggagctgtagtgtcctgctgcctctgggcgcccgctctagcgggttctgggaagtgtgcttttggcatccgttaataataaagccacggtgtgttcaggt

SEQ ID NO: 1312 - DNA, 2665 bp, Homo sapiens
  ref <308>: DATABASE ACCESSION NUMBER: NM_006748
  ref <309>: DATABASE ENTRY DATE: 2001-06-18
ggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgccgaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacaaaacattggatcatgacatgtcgggcgatgcttggaaaagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcaaacagaacttctctgggatgctgggattcttgcctgtatgaatgcatcaagtattcatttattgcccgaataggcattgcattaagtcctctgttaggtgtcaggcaagccaaaaaaaaaaaaaagatgctaagtcctaacccccaacagaagtgttcacagtgtagacgggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctaagctcatcgtgctactggtatgtgtatgtgcagttacacagtttcctgtatcataaatcctagtgtgtttatacaaggagacatctgtggtttccccaaccgttccaaaaggctatttcaaaggaaccagcccacgtatgagaaatgaatgtaacactgtggacattgacttcccgcataaggcagggtgaccccctgaactccagatgtttgcacagtatcttatgtgttgttttccgttgtgacgaatgtgattggaacatttggggagcacccagagggatttttcagtgggaagcattacactttgctaaatcatgtatttattcctgattaaaacaaacctaataaatatttaacccttggc

SEQ ID NO: 1313 - DNA, 1832 bp, Homo sapiens
  ref <308>: DATABASE ACCESSION NUMBER: NM_006759
  ref <309>: DATABASE ENTRY DATE: 2001-06-18
aggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcctgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaacaaaacctacaatacagatgtccctcttgttttaatgaactcttttaacacggatgaagataccaaaaaaatactacagaagtacaatcattgtcgtgtgaaaatctacactttcaatcaaagcaggtacccgaggattaataaagaatctttacggcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatcaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgttgacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagctttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagatagtgtctggaaaccttcgcatcttggaccactgaaatgaaaaatactgtggacacttaaataatgggctagtttcttacaatgaaatgttctctaggatttaggcactaaaaggtactttactatgttactgtaccctgcagtgttgatttttaaaatagagttttctgcagtatgcttttagtctaagaaaagcacagatggtgcaatactttccttctttgaagagatcccaaagttagttactcttaagtgc

SEQ ID NO: 1314 - DNA, 2232 bp, Homo sapiens
  ref <308>: DATABASE ACCESSION NUMBER: NM_006762
  ref <309>: DATABASE ENTRY DATE: 2001-06-18
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcaacaacaagcttcaaggaattc

SEQ ID NO: 1315 - DNA, 2717 bp, Homo sapiens
  ref <308>: DATABASE ACCESSION NUMBER: NM_006763
  ref <309>: DATABASE ENTRY DATE: 2001-06-18
cagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaaaaaaaa

SEQ ID NO: 1316 - DNA, 2126 bp, Homo sapiens
  ref <308>: DATABASE ACCESSION NUMBER: NM_006769
  ref <309>: DATABASE ENTRY DATE: 2001-06-18
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctctcctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaataaaaaaaaaaaaaaaaaaaaaaaaaaaaaaaaaaaaaaaaaaaaaaaaaaaaaaaaaaaaaaaa

SEQ ID NO: 1317 - DNA, 1712 bp, Homo sapiens
  ref <308>: DATABASE ACCESSION NUMBER: NM_006770
  ref <309>: DATABASE ENTRY DATE: 2001-06-18
atgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcaaaaaaaccggaatt

SEQ ID NO: 1318 - DNA, 1327 bp, Homo sapiens
  ref <308>: DATABASE ACCESSION NUMBER: NM_006780
  ref <309>: DATABASE ENTRY DATE: 2001-06-18
ggtcgacgacgtggcagccgggatgcactaggcaaagccagctgggctcctgagtccggtgggtacttggagaacttactacgtctagctggaggattgtaaatgtaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactattttttaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctctactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtgctcacgcctgtaataccagcactttgggaggctgaggcaggcggatcacttgaggtcaggagtttgaaactagcctggccaacgtggcaaaactccatctctattaaaaatacaaaaattagccaggcatagtggtgcatgcctgtagtcccagctacttgggatgccgaggcaggaagaattgcttgaacctgggaggcagagtctgcagtgagccgagatcatgccactgcactccagcctgggtgacagagccactccgtctcaaaaaaaaaaaaaaaaaaaaaaaaaaaaaaaa

SEQ ID NO: 1319 - DNA, 1982 bp, Homo sapiens
  ref <308>: DATABASE ACCESSION NUMBER: NM_006787
  ref <309>: DATABASE ENTRY DATE: 2001-06-18
tagagaaggcagacgcatcccgaactcgctggaggacaaggctcagctcttgccaggccaaattgagacatgtctgacacaagcgagagtggtgcaggtctaactcgcttccaggctgaagcctcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctatccaacacagcactctaggcagccact

SEQ ID NO: 1320 - DNA, 1210 bp, Homo sapiens
  ref <308>: DATABASE ACCESSION NUMBER: NM_006806
  ref <309>: DATABASE ENTRY DATE: 2001-06-18
gggcccgttgaggcggagctcagttcccggccaggacacggtctgggccgccgaatctccggccgaagagcggcggcggcagggcgggaaaaaaatgaagaatgaaattgctgccgttgtcttctttttcacaaggctagttcgaaaacatgataagttgaaaaaagaggcagttgagaggtttgctgagaaattgaccctaatacttcaaggaaaatataaaaacccttggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgccgaagtttttaatattggacttgagtatttatatattgtgcatcaactctgttggatacgagaacactgtagaagtggacgatttgttctagcacctttgagaatttactttatggagcgtatgtaagttatttatat

SEQ ID NO: 1321 - DNA, 2061 bp, Homo sapiens
  ref <308>: DATABASE ACCESSION NUMBER: NM_006813
  ref <309>: DATABASE ENTRY DATE: 2001-06-18
tgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaaccctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacaga

SEQ ID NO: 1322 - DNA, 2910 bp, Homo sapiens
  ref <308>: DATABASE ACCESSION NUMBER: NM_006825
  ref <309>: DATABASE ENTRY DATE: 2001-06-18
gggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggttcgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggcccctgcaggggccctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgttctcttcctgacgcatctgtgatatcagaggtaactatgcaaagcatccaggcggttctgaatgtgaagcactacacccagcagagtcccggtgccctctgtccccactgccggcccatgtcctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaa

SEQ ID NO: 1323 - DNA, 1874 bp, Homo sapiens
  ref <308>: DATABASE ACCESSION NUMBER: NM_006826
  ref <309>: DATABASE ENTRY DATE: 2001-06-18
ggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtgcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccaaaaaaaaaaaaaaaaaaa

SEQ ID NO: 1324 - DNA, 419 bp, Homo sapiens
  ref <308>: DATABASE ACCESSION NUMBER: NM_006829
  ref <309>: DATABASE ENTRY DATE: 2001-06-18
ctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggatcgggaaaaaattcggcctcctgaaatgacagcagggagacttgggtcggcctcctgaaatgatagcagggagacttgggtgaccccccttccaggcgccatctagcacagcctggccctgatctccgggcagccaccacctcctcggtctgccccctcattaaaattcacgttcccaccctgaaa

SEQ ID NO: 1325 - DNA, 912 bp, Homo sapiens
  ref <308>: DATABASE ACCESSION NUMBER: NM_006834
  ref <309>: DATABASE ENTRY DATE: 2001-06-18
ggcacgagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcggggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgcc

SEQ ID NO: 1326 - DNA, 1260 bp, Homo sapiens
  ref <308>: DATABASE ACCESSION NUMBER: NM_006835
  ref <309>: DATABASE ENTRY DATE: 2001-06-18
atgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatccaaaatcaggaaaggctgtagaaggaaatataccttaacaggctgatttggagtgacccagaaaa

SEQ ID NO: 1327 - DNA, 2061 bp, Homo sapiens
  ref <308>: DATABASE ACCESSION NUMBER: NM_006840
  ref <309>: DATABASE ENTRY DATE: 2001-06-18
tttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatc

SEQ ID NO: 1328 - DNA, 2825 bp, Homo sapiens
  ref <308>: DATABASE ACCESSION NUMBER: NM_006845
  ref <309>: DATABASE ENTRY DATE: 2001-06-18
gcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgtggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgctcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcagacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttacgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagtcctagaggatccctactgttttctgttttatgtgtttatacattgtatgtaacaataaagagaaaaaataaaaaaaaaaaaaaaaaaaaaaaaaaaaaaaa

SEQ ID NO: 1329 - DNA, 1603 bp, Homo sapiens
  ref <308>: DATABASE ACCESSION NUMBER: NM_006847
  ref <309>: DATABASE ENTRY DATE: 2001-06-18
tgagatgagagctgccgacagttgggggtcaagggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattca

SEQ ID NO: 1330 - DNA, 1061 bp, Homo sapiens
  ref <308>: DATABASE ACCESSION NUMBER: NM_006851
  ref <309>: DATABASE ENTRY DATE: 2001-06-18
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtgaaacgttactactctgttgtatatccaggctggcccatatatccacgtaacagatacacttctctctttctcattgttaattcagtaattctaatactgtctgttataattaccattttggtacagctcaagtaccctaatttagttcttttggactaatacaattcaggaaagaaaaaacccaaaaaccaacctcattcacatatggcttttttttaaccaataacaattaggtgtacttctattttaaaacatttcagaaaaaaatatatgttatagcaatactcttac

SEQ ID NO: 1331 - DNA, 1705 bp, Homo sapiens
  ref <308>: DATABASE ACCESSION NUMBER: NM_006855
  ref <309>: DATABASE ENTRY DATE: 2001-06-18
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacacctta

SEQ ID NO: 1332 - DNA, 2170 bp, Homo sapiens
  ref <308>: DATABASE ACCESSION NUMBER: NM_006864
  ref <309>: DATABASE ENTRY DATE: 2001-06-18
ctgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccgactggataaagagggaagcccagagcccttggacagaaataacccactggaacccaagaacaaggccagattctccatcccatccatgacagagcaccatgcggggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaat

SEQ ID NO: 1333 - DNA, 921 bp, Homo sapiens
  ref <308>: DATABASE ACCESSION NUMBER: NM_006868
  ref <309>: DATABASE ENTRY DATE: 2001-06-18
ccctcggacggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggcgtggtccacggtacttgaagaagccagagcccacatcctgtgcactgctgaaggaccctacgctcggtggcctggcacctcactttgagaagagtgagcacactggctttgcatcctggaaggcctgcagggggcggggcaggaaatgtacctgaaaaggattttagaaaaccctgggaaacccaccacaccaccacaaaatggcctttagtgtatgaaatgcacatggaggggatgtagttgcatttttgctaaaaaaaaaaaaaa

SEQ ID NO: 1334 - DNA, 2088 bp, Homo sapiens
  ref <308>: DATABASE ACCESSION NUMBER: NM_006875
  ref <309>: DATABASE ENTRY DATE: 2001-06-18
gaattcggcacgagcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggaaggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgttacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtttgcccagttcccttcccaatcctacaaaggagccttcctcccagaacctgtggtccctgattttggagggggaacttcttgcttctcattttgctaaggaagtttattttggtgaagttgttcccattttgagccccgggactcttattttgatgatgtgtcaccccacattggcacctcctactaccaccacacaaacttagttcatatgcttttacttgggcaagggtgctttccttccaataccccagtagcttttattttagtaaagggaccctttcccctagcctagggtcccatattgggtcaagctgcttacctgcctcagcccaggattttttattttgggggaggtaatgccctgttgttaccccaaggcttctttttttttttttttttttttgggtgaggggaccctactttgttatcccaagtgctcttattctggtgagaagaaccttaattccataatttgggaaggaatggaagatggacaccaccggacaccaccagacaataggatgggatggatggttttttgggggatgggctaggggaaataaggcttgctgtttgttttcctggggcgctccctccaattttgcagatttttgcaacctcctcctgagccgggattgtccaattactaaaatgtaaataatcacgtattgtggggaggggagttccaagtgtgccctccttttttttcctgcctggattatttaaaaagccatgtgtggaaacccactatttaataaaagtaatagaatcagaaaaaaaaaaaaaaaaaaa

SEQ ID NO: 1335 - DNA, 8588 bp, Homo sapiens
  ref <308>: DATABASE ACCESSION NUMBER: NM_006885
  ref <309>: DATABASE ENTRY DATE: 2001-06-18
cgcggcccgagcgcctcttttcgggattaaaagcgccgccagctcccgccgccgccgccgtcgccagcagcgccgctgcagccgccgccgccggagaagcaaccgctgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggctgaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggggatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaac

SEQ ID NO: 1336 - DNA, 1424 bp, Homo sapiens
  ref <308>: DATABASE ACCESSION NUMBER: NM_006889
  ref <309>: DATABASE ENTRY DATE: 2001-06-18
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaataaaaaaaaaaaaaaaaaaaa

SEQ ID NO: 1337 - DNA, 4145 bp, Homo sapiens
  ref <308>: DATABASE ACCESSION NUMBER: NM_006892
  ref <309>: DATABASE ENTRY DATE: 2001-06-18
ggccgcgaattcggcacgagccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactgggtactgctatgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctaaaaaaaaaaaaaaaaaa

SEQ ID NO: 1338 - DNA, 1037 bp, Homo sapiens
  ref <308>: DATABASE ACCESSION NUMBER: NM_006912
  ref <309>: DATABASE ENTRY DATE: 2001-06-18
cgcgagtgaaggaagacgaatgcgtgacccgaccggctgtggtgttccagtccccactgaccagtaggagcagcagggcgtcggcttgtgaggtggcttttcctcggggcaacccaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctaccaaaaaaaaaa

SEQ ID NO: 1339 - DNA, 2092 bp, Homo sapiens
  ref <308>: DATABASE ACCESSION NUMBER: NM_006918
  ref <309>: DATABASE ENTRY DATE: 2001-06-18
ccacgcgtccggtgcggacgggcgcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagcccttcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggccccaacttgtatttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgattgcccagataatatattaggcactactgattttttagttaaattgatgcactacacttttgatgtttgaagttacaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgtaaaaaaaaaaaaaaaggcggc

SEQ ID NO: 1340 - DNA, 1075 bp, Homo sapiens
  ref <308>: DATABASE ACCESSION NUMBER: NM_006923
  ref <309>: DATABASE ENTRY DATE: 2001-06-18
gttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 1341 - DNA, 3915 bp, Homo sapiens
  ref <308>: DATABASE ACCESSION NUMBER: NM_006931
  ref <309>: DATABASE ENTRY DATE: 2001-06-18
gtggggtggggtggggctgggggcttgtcgccctttcaggctccaccctttgcggagattataaatagtcatgatcccagcgagacccagagatgcctgtaatggtgagactttggatccttcctgaggacgtggagaaaactttctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataatttttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttccttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcgagtgtgctttagcttgaaaaggtgaccttgcaacttcatgtcaactttctggctcctcaaacagtaggttggcagtaaggcagggtcccatttctcactgagaagattgtgaatatttccatatggattttctattgttactctggttctttgttttaaaataaaaattctgaatgtacacg

SEQ ID NO: 1342 - DNA, 2565 bp, Homo sapiens
  ref <308>: DATABASE ACCESSION NUMBER: NM_006941
  ref <309>: DATABASE ENTRY DATE: 2001-06-18
cgactgagccccagactggaggagaggtccgaggaggtgggcgttggactctttgcgaggaccccggcggctggcccgggggaggcggccgaagcggcggcggcggcggccgggggcgacatggcggaggagcaggatctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcagaaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagaactgcagtcgggcaaggcagacccgaagcgggacgggcgttccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcttctcaccccttgcctcccagtggtatttgaataaagtatgtagctataaaaaaaaaaaaaaaaaa

SEQ ID NO: 1343 - DNA, 3131 bp, Homo sapiens
  ref <308>: DATABASE ACCESSION NUMBER: NM_006943
  ref <309>: DATABASE ENTRY DATE: 2001-06-18
ccgcggcggagccagaggctgcaggaagagcccgcgggggcccggagggtgcgattcctcggcccccgcaaaacaatgtgtgttgtgagccaggacgcaacttgccggagcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagcggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctcccccctcctggacgtgcccatcccccctcagatccagacatcccctcccccgcagacacaccccaaggcagtccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggaccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccacccagcggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcccaccggcccttcctgtcacccaggtccaccctcagtactcaagctgcagtatacagcgggaaaaactgaggcactttggtgctaggggtttgggactgaggcgtggagagcagatctgatggcaggaagactctcgcttttaaacatctgggtttggggagagacatcgacttggccagtgagactgagaatggattccgagtagtgatgggccgttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacacccgccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctttctatttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgcg

SEQ ID NO: 1344 - DNA, 934 bp, Homo sapiens
  ref <308>: DATABASE ACCESSION NUMBER: NM_006984
  ref <309>: DATABASE ENTRY DATE: 2001-06-18
gagcgagcgcgctgcagcgcgcgcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacagg

SEQ ID NO: 1345 - DNA, 1177 bp, Homo sapiens
  ref <308>: DATABASE ACCESSION NUMBER: NM_007005
  ref <309>: DATABASE ENTRY DATE: 2001-06-18
ggaaaggaaggtttaaaataattaatttaaaatgtcactaagtatagactgatgactgtatagagatgtgaaatgtataattacacatggaagcaatatgttgctgtgttgttattaggtttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgcattgtgccagaaacattgtgttatcttttatgttgttgttgttgctgttaaactataatatgtgacttctttttttattattttttgtttgaatgctttaaaaatctttaagtctgtggactgctgatgtacagtgcctttgctgctatggatcaaatcaaagaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttct

SEQ ID NO: 1346 - DNA, 764 bp, Homo sapiens
  ref <308>: DATABASE ACCESSION NUMBER: NM_007006
  ref <309>: DATABASE ENTRY DATE: 2001-06-18
atgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtag

SEQ ID NO: 1347 - DNA, 783 bp, Homo sapiens
  ref <308>: DATABASE ACCESSION NUMBER: NM_007019
  ref <309>: DATABASE ENTRY DATE: 2001-06-18
ggcacgagcgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttaaaaaaaaaaaaaaaaaaa

SEQ ID NO: 1348 - DNA, 5255 bp, Homo sapiens
  ref <308>: DATABASE ACCESSION NUMBER: NM_007027
  ref <309>: DATABASE ENTRY DATE: 2001-06-18
cgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgcgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcgggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtat

SEQ ID NO: 1349 - DNA, 2019 bp, Homo sapiens
  ref <308>: DATABASE ACCESSION NUMBER: NM_007036
  ref <309>: DATABASE ENTRY DATE: 2001-06-18
tgggtcacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagatatagcataagtacatgtaatttttgaagatccaaattgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacatggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgctttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaaacctatgactctataaggttttcaaacatctgaggcatgataaatttattatccataattataggagtcactctggatttcaaaaaatgtcaaaaaatgagcaacagagggaccttatttaaacataagtgctgtgacttcggtgaattttcaatttaaggtatgaaaataagtttttaggaggtttgtaaaagaagaatcaattttcagcagaaaacatgtcaactttaaaatataggtggaattaggagtatatttgaaagaatcttagcacaaacaggactgttgtactagatgttcttaggaaatatctcagaagtattttatttgaagtgaagaacttatttaagaattatttcagtatttacctgtattttattcttgaagttggccaacagagttgtgaatgtgtgtggaaggcctttgaatgtaaagctgcataagctgttaggttttgttttaaaaggacatgtttattattgttcaataaaaaagaacaagatac

SEQ ID NO: 1350 - DNA, 1532 bp, Homo sapiens
  ref <308>: DATABASE ACCESSION NUMBER: NM_007044
  ref <309>: DATABASE ENTRY DATE: 2001-06-18
taaagtgtttctttttttcttcttctttttagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaactcgagaagcc

SEQ ID NO: 1351 - DNA, 12680 bp, Homo sapiens
  ref <308>: DATABASE ACCESSION NUMBER: NM_007050
  ref <309>: DATABASE ENTRY DATE: 2001-06-18
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccccaggtggctgttcctttgatgagcactacagcaactgtggttatagtgtggctctagggaccaatgggttcacctgggagcagattaacacaacggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccaggggctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaactcgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaactgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaggctcaaccaggagtaacattctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttgacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaatatggctgtgttaaaaaatctatacaataaagctgtgaccctg

SEQ ID NO: 1352 - DNA, 1658 bp, Homo sapiens
  ref <308>: DATABASE ACCESSION NUMBER: NM_007057
  ref <309>: DATABASE ENTRY DATE: 2001-06-18
ggcacgagctcggctcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttaaaaaaaaaaaaaaaaaaa

SEQ ID NO: 1353 - DNA, 1070 bp, Homo sapiens
  ref <308>: DATABASE ACCESSION NUMBER: NM_007069
  ref <309>: DATABASE ENTRY DATE: 2001-06-18
gcgattgctggggctgcagcgctgcctccgagaccgagagtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgcgggcccggcgagaaagttgttaaagggagcgaggtggttgttcctggggtccgaggcgcgcctctcacgccctgcccaacagaagccgcagtcccgtggggtctggagacgcagtttccttgttaatgacaataaatccctgctccccctgcctcagacatctacgcagcgaaatcgagcctggccttgagggtccacaccgcgaggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcacgaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtctgtcagcgatgactttatacatcaagggggtcttgttttgctagagagtttggggtttggtttgtggatttcattgtgatttataataaggcttattttcacagaataaaataaagcaaaacgagggaggattttattgggggagtgcagcccaaaaaa

SEQ ID NO: 1354 - DNA, 1837 bp, Homo sapiens
  ref <308>: DATABASE ACCESSION NUMBER: NM_007070
  ref <309>: DATABASE ENTRY DATE: 2001-06-18
agaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaaggcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtacctc

SEQ ID NO: 1355 - DNA, 1659 bp, Homo sapiens
  ref <308>: DATABASE ACCESSION NUMBER: NM_007074
  ref <309>: DATABASE ENTRY DATE: 2001-06-18
tcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtaaaaaaaaaaaaaaaaaaaaaaaaaaaaaaaaaaaaaaaaaaaaaaaaaaagggggggggga

SEQ ID NO: 1356 - DNA, 1359 bp, Homo sapiens
  ref <308>: DATABASE ACCESSION NUMBER: NM_007088
  ref <309>: DATABASE ENTRY DATE: 2001-06-18
agcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccggatagaagcggctacattgacgagcatgagctggatgcccttttgaaggatctgtacgagaaaaacaaaaaggaaatcaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 1357 - DNA, 1440 bp, Homo sapiens
  ref <308>: DATABASE ACCESSION NUMBER: NM_007111
  ref <309>: DATABASE ENTRY DATE: 2001-06-18
ggaattccgtagctattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctagtcccaagaagatattggtaagctattgaatttagatatgcacctctgataagcaaggattgtttcccgtagattagga

SEQ ID NO: 1358 - DNA, 2306 bp, Homo sapiens
  ref <308>: DATABASE ACCESSION NUMBER: NM_007146
  ref <309>: DATABASE ENTRY DATE: 2001-06-18
agcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcaacaacaacaacaacaacatgtgacaagctggccagggaagcaagtagaaacactcagactgtgggaagaagctgttaaagcaaggaagaaagaagctgctaacctgtgccaaacctccacggctgctacgacacctgtgactctcactactccattcagtataacatcctctgtgtcgtctgagactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgacttttt

SEQ ID NO: 1359 - DNA, 1647 bp, Homo sapiens
  ref <308>: DATABASE ACCESSION NUMBER: NM_007173
  ref <309>: DATABASE ENTRY DATE: 2001-06-18
ggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagaaaaaaaaaaaaaaaa

SEQ ID NO: 1360 - DNA, 3575 bp, Homo sapiens
  ref <308>: DATABASE ACCESSION NUMBER: NM_007177
  ref <309>: DATABASE ENTRY DATE: 2001-06-18
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccagaggtttaagaaccgccctctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcaacagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggattaacaaagacagctgtttagggtcttctcccttaacccatgctttcataaaccccttcggacagcttccccgtccaggctttctaaccacacctacccagggtgccgcattcctgcactcagaagtctgcagggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaaaaaaaaaaaaaaaaaaaa

SEQ ID NO: 1361 - DNA, 1007 bp, Homo sapiens
  ref <308>: DATABASE ACCESSION NUMBER: NM_007196
  ref <309>: DATABASE ENTRY DATE: 2001-06-18
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctc

SEQ ID NO: 1362 - DNA, 5210 bp, Homo sapiens
  ref <308>: DATABASE ACCESSION NUMBER: NM_007203
  ref <309>: DATABASE ENTRY DATE: 2001-06-18
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcctgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccag

SEQ ID NO: 1363 - DNA, 3353 bp, Homo sapiens
  ref <308>: DATABASE ACCESSION NUMBER: NM_007214
  ref <309>: DATABASE ENTRY DATE: 2001-06-18
tccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttgaaagtgtatcataaaccagaacagtacagaactgatgttgaggaaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaaaaaaaaagaactcgagggggggaacg

SEQ ID NO: 1364 - DNA, 1218 bp, Homo sapiens
  ref <308>: DATABASE ACCESSION NUMBER: NM_007217
  ref <309>: DATABASE ENTRY DATE: 2001-06-18
tgcaaggtgggaagtgaagtcagtgcctcagttgctgatcagtgtgttttttgtgtccaattcttttatcaccaaaaaagggaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagccctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatattgttaagagatgtacttctcagtggcagtattgaactgcctttatctgtaaattttaaagtttgactgtataaattatcagtccctcctgaagggatctaatccagaatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatccgaaaaaaaaaaaaaaaaaaaaacctgccc

SEQ ID NO: 1365 - DNA, 4520 bp, Homo sapiens
  ref <308>: DATABASE ACCESSION NUMBER: NM_007231
  ref <309>: DATABASE ENTRY DATE: 2001-06-18
taggaacaggggagagtgcacctgctaccagtcaagctcagccagactgcaagaggaggcgaggcggagccagccgagggagtgaaccatggacaagttgaaatgcccgagtttcttcaagtgcagggagaaggagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacggcagtgaaatttatcagccagggcagcttcccagtgaacaatattggaataaagtggcgctccaacggtcaagtggaatgaatgagactggagtaattgtttggtatttagcactttgtcttcttctggcttggctcatagttggagcagcactatttaaaggaatcaaatcgtctggcaaggtggtatattttacagctcttttcccctatgtggtcctactcatcctgttagtacgaggtgcaactctggagggtgcttcaaaaggcatttcatactatattggagcccagtcaaattttacaaaacttaaggaagctgaggtatggaaagatgctgccactcagatattttactccctttcagtggcttggggtggcttagttgctctatcatcttacaataagttcaaaaacaactgcttctctgatgccattgtggtttgtttgacaaactgtctcactagcgtgtttgctggatttgctattttttctatattgggacacatggcccatatatctggaaaggaagtttctcaagttgtaaaatcaggttttgatttggcattcattgcctatccagaggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattgcaatatttatctggtcattggtgcaatttcatagacctaattatggcgcaattccataccctgactggggagttgctttaggctggtgtatgattgttttctgcattatttggataccaattatggctatcataaaaataattcaggctaaaggaaacatctttcaacgccttataagttgctgcagaccagcttctaactggggtccatacctggaacaacatcgtggggaaagatataaagacatggtagatcctaaaaaagaggctgaccatgaaatacctactgttagtggcagcagaaaaccggaatgagatctcattgaaaaaaatatatgattgtataatgtgattttttttagaatagggggaaccttatttatttgtgtgttaactgaataggaaaatgtacatactatgttcatgatagtgtgatttttttcacatttaagcaggaatgcaatataaaaatgtgaatctcttaattctcagccatgtgcttattatatttctttttagattgtctatctgtataacacacacacacacacctaagagtctctatttcacaattatatttttgtaaatagtatatgcatttttaatacattggaggctttattttgaactaatttcttagagaatagttatattttctattacacaagtttaaaaatattattaacttgtattttcttaatatacaatctatcttttccacaaatatgagtgggaaataaatcagcacatttgaaagaaagtgttaaaactgaaggcctcacttaattagaaacgtgataaatatatggacaaatggactatacatactataagaggactgtagtttaatactttttacccaaatatgtttaaaaacatcgtgcatttgttacagctcatgttttctatatgaacttagtcattaatgttctttataaaaagtgaaataagatggaaaaattaggatcctacagccagtacgtgataaatctagaaaattgagttttgagtacctcttttcccatatacaatcttccttccttaggtaatttggaagaaaactatgacccatttaatttctattgtgtttcaccaaattcagtgttgttcattatacctctctgaaatataggtttaatttcaaatagaatatggacttaaatgttaatgagaaactggctttaatcaattctagcattttattactgtaatacagggctgatagagtgattttgtcttatatgagtcagttactacttacaggtgataacttgcatactattggaagataaagttgtcaaacttgtcaagaatgagaaaagccaaattagaaaatcctatgtcctagtttccttaccaaggataattaaatatatcactaagagctttatatattgattatatattgttgacaactggtttaagcatcatagcctatgatgataaacactgcctatatatgtaaatagcttttcatcaattcttaaatttcttaacctaggcttcagggagcatatgaaaccaaaattatatggaacattttctgtgtgtacatgtacatgcatttttctagggagagagtccgtaggtttatcagaatatcaaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttctttttcctttttttttttttttggtggggggctgggggtcagagtcttgttctgttgcctgggctggagtgcagtggcatgatctcagctcactgcaacctctgccttctggattcaagtgattctcctgcctcagcctcttgagtagctgggactacaggtgcccgccaccacaccagctaatttttgtatttttagtagaggcgaagtttccccatgttggccaggctggtcttgaactcccgacctcaagtgatctgtctacctcggcctcctaaagtgctgagattacaggtgtgagccaccgtgcccggcccattctaagggttttctttgaagacaggtcaaatgctgttagtaagtttcaggagattgttaattcctcagttataccagattttataaaatatttgagaatagatggctaacaagaggttagaaatacttttccttaattttaatccacagtatgttacatgcattctaccactacattttggtgctatttaaggtgtgcaattttctataggtgacttttgcaattcagggaagatttgggcatattaaatgaaagaatatctaattgggggaggtgtgaagggaaagaaattcttttcaaaagctgaccacaaagagtagttaaaagtttttgtcactatcttcacaagtgtgtaaagcacagatttcaacagagtgcttggcatattgtagggtgctcaatggtggtttttattattattactcagattccacagtggcaagaaacatcattctacataatggaaaacatttacatcaaatcccacttactttaatgcgaacttggagataatttatggtattgtattgtaaaccattaatgaaaactttttcacagttgagtgaaattaaaatcactatatctc

SEQ ID NO: 1366 - DNA, 2970 bp, Homo sapiens
  ref <308>: DATABASE ACCESSION NUMBER: NM_007246
  ref <309>: DATABASE ENTRY DATE: 2001-06-18
ggcggatggaacgcggctcggcgggcgggcagtgccggcgtccgcggctgggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaaaattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagagcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtatcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgaccccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaattttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgt

SEQ ID NO: 1367 - DNA, 1787 bp, Homo sapiens
  ref <308>: DATABASE ACCESSION NUMBER: NM_007268
  ref <309>: DATABASE ENTRY DATE: 2001-06-18
ggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaaaaaaaaaaaa

SEQ ID NO: 1368 - DNA, 1492 bp, Homo sapiens
  ref <308>: DATABASE ACCESSION NUMBER: NM_007274
  ref <309>: DATABASE ENTRY DATE: 2001-06-18
tttttttttccagccaagcagcagctttattagtggtgctgggttcttcccataccctacagcgtgctcggaagcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggcagccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgacgatcagggccacgcggacgctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaa

SEQ ID NO: 1369 - DNA, 1691 bp, Homo sapiens
  ref <308>: DATABASE ACCESSION NUMBER: NM_007275
  ref <309>: DATABASE ENTRY DATE: 2001-06-18
tgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcatagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgc

SEQ ID NO: 1370 - DNA, 907 bp, Homo sapiens
  ref <308>: DATABASE ACCESSION NUMBER: NM_007281
  ref <309>: DATABASE ENTRY DATE: 2001-06-18
cttttcttaagggaaaaatcacgctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaatttttctctgtggaaaaa

SEQ ID NO: 1371 - DNA, 3753 bp, Homo sapiens
  ref <308>: DATABASE ACCESSION NUMBER: NM_007309
  ref <309>: DATABASE ENTRY DATE: 2001-06-18
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaacaggattgggttgatggtacaacatgactttttaagataatcaagttagttaaaagtttcctagttggaaaactttgaaaaaaaaaaaaa

SEQ ID NO: 1372 - DNA, 4003 bp, Homo sapiens
  ref <308>: DATABASE ACCESSION NUMBER: NM_007315
  ref <309>: DATABASE ENTRY DATE: 2001-06-18
attaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatcgacacagtgctttccgtggcactgcatacaatctgaggcctcctctctcagtttttatatagatggcgagaacctaagtttcagttgattttacaattgaaatgactaaaaaacaaagaagacaacattaaaaacaatattgtttcta

SEQ ID NO: 1373 - DNA, 1271 bp, Homo sapiens
  ref <308>: DATABASE ACCESSION NUMBER: NM_007334
  ref <309>: DATABASE ENTRY DATE: 2001-06-18
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatataatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaa

SEQ ID NO: 1374 - DNA, 2648 bp, Homo sapiens
  ref <308>: DATABASE ACCESSION NUMBER: NM_007358
  ref <309>: DATABASE ENTRY DATE: 2001-06-18
caccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccgaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgaggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaagggagtctggcttttactatctttcttaaaaaaaaaaaaaaagagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgcaaaaaaaaaaaaa

SEQ ID NO: 1375 - DNA, 2263 bp, Homo sapiens
  ref <308>: DATABASE ACCESSION NUMBER: NM_009585
  ref <309>: DATABASE ENTRY DATE: 2001-06-18
attcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgc

SEQ ID NO: 1376 - DNA, 1696 bp, Homo sapiens
  ref <308>: DATABASE ACCESSION NUMBER: NM_009587
  ref <309>: DATABASE ENTRY DATE: 2001-06-18
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggca

SEQ ID NO: 1377 - DNA, 848 bp, Homo sapiens
  ref <308>: DATABASE ACCESSION NUMBER: NM_009588
  ref <309>: DATABASE ENTRY DATE: 2001-06-18
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactgggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

SEQ ID NO: 1378 - DNA, 2493 bp, Homo sapiens
  ref <308>: DATABASE ACCESSION NUMBER: NM_012062
  ref <309>: DATABASE ENTRY DATE: 2001-06-18
ggaggcgaactgtgggccccggccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtgacacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaaaaaaaaaa

SEQ ID NO: 1379 - DNA, 1247 bp, Homo sapiens
  Modified_base 1 ... 1247: n = a,c,g, or t
  ref <308>: DATABASE ACCESSION NUMBER: NM_012067
  ref <309>: DATABASE ENTRY DATE: 2001-06-18
ggaattcgccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcgtgtacagcgacggccagtccgagaccatccttggcggcctggggctccggctgggcggcagcgactgcagagtgaaaattgataccaaggccattccactgtttgggaactccctgaagcctgacagtctccggttccagctggagacgtcactgaagcggctgcagtgtccccgagtggacctcttctacctgcatatgccagaccacagcaccccggtggaagagacactgcgtgcctgccaccagctgcaccaggagggcaagttcatggagcttggcctctccaactatgcagcctgggaagtggccgagatctgtaccctctgcaagagcaacggctggatcctgcccactgtgtaccagggcatgtacaatgccatcacccggcaggtggaaacggagctcttcccctgcctcaggcactttggactgaggttctatgccttcaaccctctggctgggggcctgctgaccggcaagtacaagtatgaggacaaggatgggaaacagcctgtgggccgcttctttgggaatacctgggcagagatgtacaggaatcgctactggaaggagcaccactttgagggcattgccctggtggagaaggccctgcaggccgcgtatggcgccagcgcccccagcatgacctcggccaccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttggttgctcacgaatgtcccaactacttccgctaggcccatcgtttctcaggctgcccaaggctcttctgtaacatcttttgttactcacattttctttaatttagaactgcctcagtaaattcttagggatggaagtntttggacaaaaacctaatagaagagtcaccaccaaatgaagaataaaactcccaaaaaaaaaa

SEQ ID NO: 1380 - DNA, 3018 bp, Homo sapiens
  ref <308>: DATABASE ACCESSION NUMBER: NM_012101
  ref <309>: DATABASE ENTRY DATE: 2001-06-18
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgacgtgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagtggccaagggctgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtc

SEQ ID NO: 1381 - DNA, 1885 bp, Homo sapiens
  ref <308>: DATABASE ACCESSION NUMBER: NM_012105
  ref <309>: DATABASE ENTRY DATE: 2001-06-18
tcgcccggtcgacgccgcggctgccggacgggacgggaccggctaggctgggcgcccccccgggccccgccgtgggcatgggcgcactggcccgggcgctgctgctgcctctgctggcccagtggctcctgcgcgccgccccggagctggcccccgcgcccttcacgctgcccctccgggtgaccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaacaattaaaaaaaaaaacttcattctaaaccaaaaaaaaaaaaaaaaaa

SEQ ID NO: 1382 - DNA, 1507 bp, Homo sapiens
  ref <308>: DATABASE ACCESSION NUMBER: NM_012108
  ref <309>: DATABASE ENTRY DATE: 2001-06-18
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtctccattccc

SEQ ID NO: 1383 - DNA, 1034 bp, Homo sapiens
  ref <308>: DATABASE ACCESSION NUMBER: NM_012110
  ref <309>: DATABASE ENTRY DATE: 2001-06-18
tgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgttttttttttttttttaaataaccgcatgttctaagtgtgcatttttgtcaatctttgcaacagttatttcatacagatgtttaatacttaagttattgtgctcttttctgttatgtattctgattttcaaggattactttttttgtattatcaaaaaaatac

SEQ ID NO: 1384 - DNA, 2058 bp, Homo sapiens
  ref <308>: DATABASE ACCESSION NUMBER: NM_012124
  ref <309>: DATABASE ENTRY DATE: 2001-06-18
cggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgacttgcatcagactggaggtgaagttaccatttcagtatatgctaaaaactcacttccagaacttagccgagtagaagcaaatagcacattgttaaatgtcattattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttaaaaaaaaaaaaaaaaaaa

SEQ ID NO: 1385 - DNA, 1618 bp, Homo sapiens
  ref <308>: DATABASE ACCESSION NUMBER: NM_012135
  ref <309>: DATABASE ENTRY DATE: 2001-06-18
agagcccggggcgagtgggcctctgctcgtgggtggttctcgtggaggtcagctcccgcgtgtctccgctcgacagggtgcttgggcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttatta

SEQ ID NO: 1386 - DNA, 1548 bp, Homo sapiens
  ref <308>: DATABASE ACCESSION NUMBER: NM_012142
  ref <309>: DATABASE ENTRY DATE: 2001-06-18
cgttgctgtcggtggagcggctgtcgcagtgcggctccggcagtggcagcggaggcctgtgtttgcggccttcggcaagcgactgagatggcgagcgcaactgcaccctgcagccgcagtccccacccctggcttcgccctttggagcagctccggcacttggcggaggagctgcggttgctcctgcctcgagtgcgggtcggcgaagaccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagatggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgacatggacaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaaaaaaaaaaaaaaaaaaaa

SEQ ID NO: 1387 - DNA, 1743 bp, Homo sapiens
  ref <308>: DATABASE ACCESSION NUMBER: NM_012151
  ref <309>: DATABASE ENTRY DATE: 2001-06-18
gccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcttc

SEQ ID NO: 1388 - DNA, 2269 bp, Homo sapiens
  ref <308>: DATABASE ACCESSION NUMBER: NM_012155
  ref <309>: DATABASE ENTRY DATE: 2001-06-18
ccacccccggccccgaagctccgccacccgccgccatgagtagctttggagctggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaaaaaaaaaaaaaaaaaaaaaaa

SEQ ID NO: 1389 - DNA, 2397 bp, Homo sapiens
  ref <308>: DATABASE ACCESSION NUMBER: NM_012175
  ref <309>: DATABASE ENTRY DATE: 2001-06-18
ctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatgacactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgggagttaagaatgaaatccttcaagtgttataaactcacattttaaaagcaaattttggttcc

SEQ ID NO: 1390 - DNA, 2076 bp, Homo sapiens
  ref <308>: DATABASE ACCESSION NUMBER: NM_012177
  ref <309>: DATABASE ENTRY DATE: 2001-06-18
aggttgctcagctgcccccggagcggttcctccacctgaggcagacaccacctcggttggcatgagccggcgcccctgcagctgcgccctacggccaccccgctgctcctgcagcgccagccccagcgcagtgacagccgccgggcgccctcgaccctcggatagttgtaaagaagaaagttctaccctttctgtcaaaatgaagtgtgattttaattgtaaccatgttcattccggacttaaactggtaaaacctgatgacattggaagactagtttcctacacccctgcatatctggaaggttcctgtaaagactgcattaaagactatgaaaggctgtcatgtattgggtcaccgattgtgagccctaggattgtacaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaagcttaaaaaaaaaaaaaaaaaactcgagactagtgc

SEQ ID NO: 1391 - DNA, 1247 bp, Homo sapiens
  ref <308>: DATABASE ACCESSION NUMBER: NM_012205
  ref <309>: DATABASE ENTRY DATE: 2001-06-18
cgcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggttggccaagcaccctcgagtgccatccctgccaaacaactctcccagcccccactacctctctgtgtactgccgctgtgtcccccacagacctgcacattgttgtcacccaccctcctgcccttctcagcccagatgccatgccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgc

SEQ ID NO: 1392 - DNA, 2115 bp, Homo sapiens
  ref <308>: DATABASE ACCESSION NUMBER: NM_012214
  ref <309>: DATABASE ENTRY DATE: 2001-06-18
gaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactatt

SEQ ID NO: 1393 - DNA, 1081 bp, Homo sapiens
  ref <308>: DATABASE ACCESSION NUMBER: NM_012219
  ref <309>: DATABASE ENTRY DATE: 2001-06-18
ggcggcggcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaaggcctcgggcacagtgacggtggcctggccagccctcgggacccctccccacctaactgcactgaaaccatttctaaccacaacccttggcccaaggacttggtacaggaagggagaagggcaggtgggcagggagcaagacagggtctggcttttgccaagaggaacggggctttttccaccttcttcaaaagagacaagggaaggccacctgttaaagcaggaagcagcatcaagttgccccttgggcccccccatgttgtttggatttcaaaccgggtttccttcccccttcttttcgggttgggtgttgttggttatttggttaactacatatggtt

SEQ ID NO: 1394 - DNA, 1554 bp, Homo sapiens
  ref <308>: DATABASE ACCESSION NUMBER: NM_012242
  ref <309>: DATABASE ENTRY DATE: 2001-06-18
ggccattaccaatcgcgaaaccccgcagggggctcccggaccctgactctgcagccgaaccggcacggtttcctggggacccaggcttgcaaagtgacggtcattttctccttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaaaaaaaaaaaaaaaaaaaaaaaaaaaaaaaaaaaaa

SEQ ID NO: 1395 - DNA, 612 bp, Homo sapiens
  ref <308>: DATABASE ACCESSION NUMBER: NM_012250
  ref <309>: DATABASE ENTRY DATE: 2001-06-18
atggccgcggcggctggcggacggctccggcaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctag

SEQ ID NO: 1396 - DNA, 2103 bp, Homo sapiens
  ref <308>: DATABASE ACCESSION NUMBER: NM_012258
  ref <309>: DATABASE ENTRY DATE: 2001-06-18
cccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaa

SEQ ID NO: 1397 - DNA, 1749 bp, Homo sapiens
  ref <308>: DATABASE ACCESSION NUMBER: NM_012261
  ref <309>: DATABASE ENTRY DATE: 2001-06-18
gatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 1398 - DNA, 1826 bp, Homo sapiens
  ref <308>: DATABASE ACCESSION NUMBER: NM_012286
  ref <309>: DATABASE ENTRY DATE: 2001-06-18
cacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttc

SEQ ID NO: 1399 - DNA, 1370 bp, Homo sapiens
  ref <308>: DATABASE ACCESSION NUMBER: NM_012317
  ref <309>: DATABASE ENTRY DATE: 2001-06-18
ctggccaccaagcgcctccgtggacacgcacttcctgcgagggctccgtgcgcaccttggccgagccgaaccgagccgagtcctgtccttccaggccgttcgcaatggtggatgagttggtgctgctgctgcacgcgctcctgatgcggcaccgcgccctgagcatcgagaacagccagctcatggaacagctgcggctgctggtgtgcgagagggccagcctgctgcgccaggtacgtccgccgagctgcccggtgcccttccccgaaacgtttaatggcgagagctcccggctccccgagtttatcgtgcagacggcgtcttacatgctcgtgaacgagaaccgattctgcaacgacgccatgaaggtggcattcctaatcagcctcctcaccggggaagccgaggagtgggtggtgccctacatcgagatggatagccccatcctaggtgattaccgggccttcctcgatgagatgaaacagtgctttggctgggatgacgacgaagacgacgacgacgaagaagaggaggatgattattaggccctcgaccctcgggcctcgggggggagggccctgcacgccgccaccccctccccgcagccctcaccccgccaggagccactgctctcccccttgccctccggtccccttacctacccgcgcccgtctgctctctctcttcatttctccgtagtgcttgtctttgttccaggaatagcgctccagttacctgctgctggggtcggggctggagcctcactcactcggaagtgcttggaagtgtcatctaccctggccatccccgggatccctcccctgctaatctgaactgtgtcctgaaccccagctattggccaggcccctgttacaaactgcgcagaccacccgtagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaagcacc

SEQ ID NO: 1400 - DNA, 2744 bp, Homo sapiens
  ref <308>: DATABASE ACCESSION NUMBER: NM_012319
  ref <309>: DATABASE ENTRY DATE: 2001-06-18
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactttggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtg

SEQ ID NO: 1401 - DNA, 1954 bp, Homo sapiens
  ref <308>: DATABASE ACCESSION NUMBER: NM_012332
  ref <309>: DATABASE ENTRY DATE: 2001-06-18
acaccctctgccgactccaagacgctgcctcttcctgcgggcgaggcgcgcggtctggtactcgtgcgtcttttatcgcctgagtttccctccgccgactagcgcgcggggcccggttctccatcgcgcgcacggcagcctagcgcaatgaggcgggcaccctgcgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattataggcatgagccactgcacccggccggtggaaagcatttttaacaaaaaatttttaggccaggcacagtggtggctcatgcctgtaatcccagcactttgggagactgagatgggaggatcgcttgagaccagcctggggaacatagtgagaccctttctctacaaaaagttaaaaaattatctgagcatggtggtgtgcacctgtagtcccagttaggaggctgaggtgagtggattgcttgagtccgggagtttgagtctgcagtgagctatgatcatgccactgcactccagtctgggtgacagcaagac

SEQ ID NO: 1402 - DNA, 1606 bp, Homo sapiens
  ref <308>: DATABASE ACCESSION NUMBER: NM_012336
  ref <309>: DATABASE ENTRY DATE: 2001-06-18
gcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctcaaaaaaaaaaaaaaaaaaa

SEQ ID NO: 1403 - DNA, 1850 bp, Homo sapiens
  ref <308>: DATABASE ACCESSION NUMBER: NM_012337
  ref <309>: DATABASE ENTRY DATE: 2001-06-18
cggcgccggggcggcagcagaagtccggagtcagggcgtgtggctgaggagatgccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggggggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgactaaaaaaaaaaaaaaaaaaaaaaaaaaa

SEQ ID NO: 1404 - DNA, 1703 bp, Homo sapiens
  ref <308>: DATABASE ACCESSION NUMBER: NM_012339
  ref <309>: DATABASE ENTRY DATE: 2001-06-18
gaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacttctcagtcaacatcgtggggctggacagggttgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaataataaaaacatgttttgttttgttaaaaaaaaaaaaaaaaa

SEQ ID NO: 1405 - DNA, 2414 bp, Homo sapiens
  ref <308>: DATABASE ACCESSION NUMBER: NM_012341
  ref <309>: DATABASE ENTRY DATE: 2001-06-18
cccgcgtgcatacggttgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggtacagtatggtttcatgaaattggagctctgtacaaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaactaaaaaaaaaaaaaaaaaaaaaaaaa

SEQ ID NO: 1406 - DNA, 1894 bp, Homo sapiens
  ref <308>: DATABASE ACCESSION NUMBER: NM_012391
  ref <309>: DATABASE ENTRY DATE: 2001-06-18
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccatggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactg

SEQ ID NO: 1407 - DNA, 644 bp, Homo sapiens
  ref <308>: DATABASE ACCESSION NUMBER: NM_012394
  ref <309>: DATABASE ENTRY DATE: 2001-06-18
gctccctggggaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatcttaaaaaaaaaaaaaaaaaaaaaaa

SEQ ID NO: 1408 - DNA, 1573 bp, Homo sapiens
  ref <308>: DATABASE ACCESSION NUMBER: NM_012413
  ref <309>: DATABASE ENTRY DATE: 2001-06-18
ggctgggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagaggcaccgtgtaaagaaaatggcaaaataaatatctttccaaggatcatcatcacgatagctaaacagtacttaaatagcggttggaactaggtagcctttcgaattttatgattttttcatatgtggaaatctattacatgtaatacaaaacaaacatgtagtttgaaggcggtcagatttctttgagaaatctttgtagagttaattttatggaaattaaaatcagaattaaatgctaaaaaaaaaaaaaaaaa

SEQ ID NO: 1409 - DNA, 6229 bp, Homo sapiens
  ref <308>: DATABASE ACCESSION NUMBER: NM_012421
  ref <309>: DATABASE ENTRY DATE: 2001-06-18
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagactttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatacgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagctctctctgtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcacc

SEQ ID NO: 1410 - DNA, 1436 bp, Homo sapiens
  ref <308>: DATABASE ACCESSION NUMBER: NM_012425
  ref <309>: DATABASE ENTRY DATE: 2001-06-18
cagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtat

SEQ ID NO: 1411 - DNA, 1260 bp, Homo sapiens
  ref <308>: DATABASE ACCESSION NUMBER: NM_012427
  ref <309>: DATABASE ENTRY DATE: 2001-06-18
cttgtggttcctctctacttggggaaatcaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaaa

SEQ ID NO: 1412 - DNA, 2388 bp, Homo sapiens
  ref <308>: DATABASE ACCESSION NUMBER: NM_012428
  ref <309>: DATABASE ENTRY DATE: 2001-06-18
gaaggacggagccgagccgcggctgcctccctcgctcactccctcgcgcactcgcccgccccctccctccctcccctcccttccccgggcccgggtctggccccggcccattcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacaggtatatacagcatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaactattgaagtgcaatgatgtataaaaaagtggattcacctgtttttaaaaataaaacattgataaaaaaaaaaaa

SEQ ID NO: 1413 - DNA, 2818 bp, Homo sapiens
  ref <308>: DATABASE ACCESSION NUMBER: NM_012429
  ref <309>: DATABASE ENTRY DATE: 2001-06-18
ccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgca

SEQ ID NO: 1414 - DNA, 1731 bp, Homo sapiens
  ref <308>: DATABASE ACCESSION NUMBER: NM_012446
  ref <309>: DATABASE ENTRY DATE: 2001-06-18
gggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagaggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggccctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaaccttttcatttcctgctctctcccctcttttgtgaagaaagcgggtccagatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtatatgtctgcaatcatggataggaataaaatcgcttatttgagagctttcaaaaaaaaaaaaaaaaaaac

SEQ ID NO: 1415 - DNA, 2718 bp, Homo sapiens
  ref <308>: DATABASE ACCESSION NUMBER: NM_012463
  ref <309>: DATABASE ENTRY DATE: 2001-06-18
ccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaacgttgagtttgaacccacttatgaagaattcccttccttagagagcgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaagtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgtgggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaacgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatac

SEQ ID NO: 1416 - DNA, 831 bp, Homo sapiens
  ref <308>: DATABASE ACCESSION NUMBER: NM_012474
  ref <309>: DATABASE ENTRY DATE: 2001-06-18
gttgacaagagacattccagcccaccacttcccaagtaaagaattaaaatgcagcatgatggctaaggcaagggcctgcagaagaatgtaaaggagggaggaagagcaggggattcagagcaggaaggaggagacagtactgtctatcccgcagacgtggtgctctttgaagggatcctggccttctactcccaggaaaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagcagtatgctgatgtgatcatccctagaggtgcagataatctggtggccatcaacctcatcgagcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggcgtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagtaataaatacatatatatat

SEQ ID NO: 1417 - DNA, 2116 bp, Homo sapiens
  ref <308>: DATABASE ACCESSION NUMBER: NM_013230
  ref <309>: DATABASE ENTRY DATE: 2001-06-18
cggttctccaagcacccagcatcctgctagacgcgccgcgcaccgacggaggggacatgggcagagcaatggtggccaggctggggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatgaatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcattggttcattaattctataaggccataaaacaggtaatataaaaagcttccatcgatctatttatatgtacatgagaaggaatccccaggtgttactgtaattcctcaacgtattgtttcgacggcactaatttaatgccgatatactctagatgaatgtttacattgttgagctattgctgttctcttgggaactgaactcactttcctcctgaggctttggatttgacattgcatttgaccttttaggtagtaattgacatgtgccagggcaatgatgaatgagaatctaccccagatccaagcatcctgagcaactcttgattatccatattgagtcaaatggtaggcatttcctatcacctgtttccattcaacaagagcactacattcttttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttagaactcctgacctcaggtgatccacccgcctcggcctcccaaagtgctgggattacaggcttgagcccccgcgcccagccatcaaaatgctttttatttctgcatatgtttgaatactttttacaatttaaaaaaatgatctgttttgaaggcaaaattgcaaatcttgaaattaagaaggcaaaatgtaaaggagtcaaactataaatcaagtatttgggaagtgaagactggaagctaatttgcataaattcacaaacttttatactctttctgtatatacattttttttctttaaaaaacaactatggatcagaatagcaacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgtttgtatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtggttgtgtatttacgctttgattcatagtaacttcttatggaattgatttgcattgaacgacaaactgtaaataaaaagaaacggtg

SEQ ID NO: 1418 - DNA, 3293 bp, Homo sapiens
  ref <308>: DATABASE ACCESSION NUMBER: NM_013233
  ref <309>: DATABASE ENTRY DATE: 2001-06-18
cgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccccctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgag

SEQ ID NO: 1419 - DNA, 1074 bp, Homo sapiens
  ref <308>: DATABASE ACCESSION NUMBER: NM_013238
  ref <309>: DATABASE ENTRY DATE: 2001-06-18
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagggactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattct

SEQ ID NO: 1420 - DNA, 1482 bp, Homo sapiens
  ref <308>: DATABASE ACCESSION NUMBER: NM_013239
  ref <309>: DATABASE ENTRY DATE: 2001-06-18
attccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattc

SEQ ID NO: 1421 - DNA, 1278 bp, Homo sapiens
  ref <308>: DATABASE ACCESSION NUMBER: NM_013242
  ref <309>: DATABASE ENTRY DATE: 2001-06-18
acaggggaaataccgcggcgccggtagttgctgtggtttccgttctgagctcgcagcttaggagctgaagatcgcggacttagcgttgccgcgtccgagtccggccatcagtggctgcagatccggagccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaaaaaaaaa

SEQ ID NO: 1422 - DNA, 2479 bp, Homo sapiens
  Modified_base 1 ... 2479: n = a,c,g, or t
  ref <308>: DATABASE ACCESSION NUMBER: NM_013253
  ref <309>: DATABASE ENTRY DATE: 2001-06-18
ggcacgagggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccangtgtgtgctttaagcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatttcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctaaaaaaaaaaaaaaaaaaaaaaaaaaaaaaa

SEQ ID NO: 1423 - DNA, 2391 bp, Homo sapiens
  ref <308>: DATABASE ACCESSION NUMBER: NM_013257
  ref <309>: DATABASE ENTRY DATE: 2001-06-18
ggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaa

SEQ ID NO: 1424 - DNA, 6303 bp, Homo sapiens
  ref <308>: DATABASE ACCESSION NUMBER: NM_013261
  ref <309>: DATABASE ENTRY DATE: 2001-06-18
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacggaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacacaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacacttaaaacctagaacttcaaaatgttcgtattctattcaaaaggaaaaatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattattttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcaaaataattcttccagtgcaacaaaatcaattttttgctaaacgactccaagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatct

SEQ ID NO: 1425 - DNA, 1635 bp, Homo sapiens
  ref <308>: DATABASE ACCESSION NUMBER: NM_013262
  ref <309>: DATABASE ENTRY DATE: 2001-06-18
gggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaagcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcaatttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagagactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaagcaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagatgttggagaaagtaattattccaacacccatctgcccatgcgatgttaaaaaa

SEQ ID NO: 1426 - DNA, 3050 bp, Homo sapiens
  ref <308>: DATABASE ACCESSION NUMBER: NM_013277
  ref <309>: DATABASE ENTRY DATE: 2001-06-18
taaaggggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgtcacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaccaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggcttta

SEQ ID NO: 1427 - DNA, 2336 bp, Homo sapiens
  ref <308>: DATABASE ACCESSION NUMBER: NM_013296
  ref <309>: DATABASE ENTRY DATE: 2001-06-18
ggcacgaggaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtactccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaa

SEQ ID NO: 1428 - DNA, 1567 bp, Homo sapiens
  ref <308>: DATABASE ACCESSION NUMBER: NM_013301
  ref <309>: DATABASE ENTRY DATE: 2001-06-18
aacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggtagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaaaaaaaaaaaaaaaaaaaaaa

SEQ ID NO: 1429 - DNA, 2168 bp, Homo sapiens
  ref <308>: DATABASE ACCESSION NUMBER: NM_013324
  ref <309>: DATABASE ENTRY DATE: 2001-06-18
tccctgtcctgcgcccgcgcgccccgggagcctacccagcacgcgctccgcgcccactggttccctccagccgccgccgtccagccgagtccccactccggagtcgccgctgccgcggggacatggtcctctgcgttcaggggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaaatgcccccaggccgcatgtggcttcattatactgagccatgtgtcagaggatggggagacaggcaggaccttgtctcacctgtgggctgggcccaaacctccactcgcttgcctgccctggccacctgaactgtatgggcactctcagccctggtttttcaatccccagggtcggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcaaaccaaccccacctctatgccctgagccctggtagtccaaagaccccaactctgccctggcttctctggttcttccctgtggaaagcccatcctgagacatcttgctggaaccaaggcaatcctggatgtcctggtactgacccacccctctgtgaatgtgtccactctcttctgcccccagccatatttggggaggatggacaactacaataggtaagaaaatgcagccggagcctcagtccccagcagagcctgtgtctcaccccctcacaggacagagctgtatctgcataaagctggtctcactgtggcgcaggccccggggggagtgcctgtgctgtcaggaaaagggggtgctggtttgagggccaccactgcagttctgctaggtctgcttcctgcccaggaaggtgcctgcacatgaaaggagagaaatacacgtctgataagacttcatgaaataataattatagcaaagaacagtttggtggtcttttctcttccactgatttttctgtaatgaacattatacctttattacctctttattttattacctctataataaaatgatacctt

SEQ ID NO: 1430 - DNA, 1347 bp, Homo sapiens
  ref <308>: DATABASE ACCESSION NUMBER: NM_013327
  ref <309>: DATABASE ENTRY DATE: 2001-06-18
gcgcggcactggtcctccgccggcctcgcccacccctcggccccgagatgaagaaggacgagtcgttcctgggcaagctgggcgtgaccctggccaggaagcggagggcgcgcgaggtgagtgacctgcaggaagaaggcaagaatgcatcaactcaccgatgtcccccgccctggaatggttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaacagtacatgacctgctgcggcccgaggctgggcgctccggtggagtgggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctgggacggaggccttcaagaaacccaaggctcgtcctgaagacgtggttaacttgggacctcaaatcccccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttttggtccaagctgtgttgactgtcatccccaccccacccctacctcacgcctgccccaccccctgcctcttttggttgttgtttttaatctcctctccatgtagttcccagtgggcaagagcctttgaaaatgcaggattttaaacaaaaaaa

SEQ ID NO: 1431 - DNA, 3561 bp, Homo sapiens
  ref <308>: DATABASE ACCESSION NUMBER: NM_013336
  ref <309>: DATABASE ENTRY DATE: 2001-06-18
gcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagttagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttgcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtaaaaaaaaaaaaaaaaaaaaa

SEQ ID NO: 1432 - DNA, 1960 bp, Homo sapiens
  ref <308>: DATABASE ACCESSION NUMBER: NM_013339
  ref <309>: DATABASE ENTRY DATE: 2001-06-18
tcggcacgagcagcggccggcgggcggcggggatacttctacatagacataatcaagttttgactatttggaaaccaagcatcattaaaattctctcaaactgctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaaaaaaaaaaaaaaaaaaa

SEQ ID NO: 1433 - DNA, 1774 bp, Homo sapiens
  ref <308>: DATABASE ACCESSION NUMBER: NM_013363
  ref <309>: DATABASE ENTRY DATE: 2001-06-18
cgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctcccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggaaaaaaaaaaaaaaaaaaaagatctttaattaa

SEQ ID NO: 1434 - DNA, 4049 bp, Homo sapiens
  ref <308>: DATABASE ACCESSION NUMBER: NM_013372
  ref <309>: DATABASE ENTRY DATE: 2001-06-18
gcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacckcagaggctgaaattcctaatacctttcctttatcgtggttatagtcagctcatttccattccactatttcccataatgcttctgagagccactaacttgattgataaagatcctgcctctgctgagtgtacctgacagtaagtctaaagatgaragagtttagggactactctgttttagcaagaratattktgggggtctttttgttttaactattgtcaggagattgggctaragagaagacgacgagagtaaggaaataaagggrattgcctctggctagagagtaagttaggtgttaatacctggtagaaatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaatggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttcaaaaaaaaa

SEQ ID NO: 1435 - DNA, 548 bp, Homo sapiens
  ref <308>: DATABASE ACCESSION NUMBER: NM_013378
  ref <309>: DATABASE ENTRY DATE: 2001-06-18
gccttgcagaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaaaaa

SEQ ID NO: 1436 - DNA, 1646 bp, Homo sapiens
  ref <308>: DATABASE ACCESSION NUMBER: NM_013384
  ref <309>: DATABASE ENTRY DATE: 2001-06-18
ctggcttctcggaactttttcagaagactgcgcctgtcctggttgcggcatggctgtcactgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagtaacagagagctcagagggggagaaggctgcagctgggggaggagcaaagagccggcccctagccaatggccaccccatcctcaataacaaccatcgtaagaatgactgactgaaccattattccagctggctcccagattaatgcataaagccaaggaactaccccgctccctgcgctatagggtcactttagctctggggaaaaaggagaaaggagaggagagttctctgcatcctccctccttgcttgtcacccagttgcctttaaaccaaattctaaccagcctatccccaggtaggggacgttggttatattctgttagagggggaccggtcgtattttcctccctacccgccaagtcatcctttctactgcttttgagggcctccctcaagctctctgtgggtaggggttacaattcacattcctttattctgagaatttggccccagcagtttgcctttgactccctgaactccaaagcaagggttggtgccttaaggtcccatctgtggggcctcattctggcaaagctggaccaaggctaacctttctaacctccctaaattgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaaaaaaaaaaaaaa

SEQ ID NO: 1437 - DNA, 3221 bp, Homo sapiens
  ref <308>: DATABASE ACCESSION NUMBER: NM_013385
  ref <309>: DATABASE ENTRY DATE: 2001-06-18
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccttcccctgtcctcgggttgggcttggccctctctgcctgagagagctcagcacacacacagctcagacccacggacaggaccccgggacagaaccccgggagcactgccctaggagcctggaccccacgagctcagtcccagctctgcctctgactcgctgtgtaccctctgccaagtcatgcccattctctagttcttgcaaaactgcagtgtttggactagaaacgtattggcccctgctagccctgtgctccagcttccagctggagatggcagccgttatttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggccgcctggaggcagtggctgagccagaaagtaacacagagctcatgcttggagagatagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggtcgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaaaaaaaaaaaaaaaaaaaaa

SEQ ID NO: 1438 - DNA, 1210 bp, Homo sapiens
  ref <308>: DATABASE ACCESSION NUMBER: NM_013406
  ref <309>: DATABASE ENTRY DATE: 2001-06-18
ctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttaaaaaaaaaaaaaaaaaaaaaaaaaa

SEQ ID NO: 1439 - DNA, 3078 bp, Homo sapiens
  ref <308>: DATABASE ACCESSION NUMBER: NM_013437
  ref <309>: DATABASE ENTRY DATE: 2001-06-18
ctcctcctccgtctcctcctctctctctcatctgctgtggttatggcctgtcgctggagcacaaaagagtctccgcggtggaggtctgcgttgctcttgcttttcctcgctggggtgtacggaaatggtgctcttgcagaacattctgaaaatgtgcatatttcaggagtgtcaactgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgcaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtggaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattgcatattgttcaataatggtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaagcacatcttgtaacttaatatagctagatgttaaggttgttaatgtaccaaaaaaaaaaaa

SEQ ID NO: 1440 - DNA, 6837 bp, Homo sapiens
  ref <308>: DATABASE ACCESSION NUMBER: NM_013451
  ref <309>: DATABASE ENTRY DATE: 2001-06-18
ggcacgagcttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagggagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaaaaaaaaaaaaaaaaaaaa

SEQ ID NO: 1441 - DNA, 4318 bp, Homo sapiens
  ref <308>: DATABASE ACCESSION NUMBER: NM_013943
  ref <309>: DATABASE ENTRY DATE: 2001-06-18
aagcggctcgggctgcggctggctcagagtgccgcggggggcgtggggcggtgctgaggagctgaagccgtggccagctcgactccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaggtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaggagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattctttctggtgattctgaaccttgcctcatagcttaaagtataaaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttctttgtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattggtacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcaaaaaaaaaaaaaaaaaaaaaaaaaaaa

SEQ ID NO: 1442 - DNA, 3970 bp, Homo sapiens
  ref <308>: DATABASE ACCESSION NUMBER: NM_013994
  ref <309>: DATABASE ENTRY DATE: 2001-06-18
ggcttaggaagtattaactgatctctgccctagttctcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggtcagctcaccgacgagcaggtcatcgagaacgcgggggagttcttccgggaccagggccggcagtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaa

SEQ ID NO: 1443 - DNA, 4006 bp, Homo sapiens
  ref <308>: DATABASE ACCESSION NUMBER: NM_013995
  ref <309>: DATABASE ENTRY DATE: 2001-06-18
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttgaacaacatgttctaccgtggatttgtacttgctccttttgctctttttgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcatggtggtgggcgcctgtaatcccagttactcgggaggctgaggcaggagaatcacttgaacccgggaggcagaggttgcggtgagccaagagcgcaccattgcactccagccttgggcgacaaaaacgaaactccatcttcaaaacaaaacaaaacaaaacaaacaaacaaacaaaacttgcatcttaaccaaaagtcttggttttatcttaatccattaaaagttggtcttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatatgcacacatatataggcagttgcatgcctagcatgggtattttataaccatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaatgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattctt

SEQ ID NO: 1444 - DNA, 1163 bp, Homo sapiens
  ref <308>: DATABASE ACCESSION NUMBER: NM_014026
  ref <309>: DATABASE ENTRY DATE: 2001-06-18
gcacgaggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttcctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcaa

SEQ ID NO: 1445 - DNA, 761 bp, Homo sapiens
  ref <308>: DATABASE ACCESSION NUMBER: NM_014029
  ref <309>: DATABASE ENTRY DATE: 2001-06-18
atccccacccaaagcctgatggaccccggctggccatgctgtcccctccctgtggcgtttcttagcagatggctgcagagcttcgttgatggtcttttctgtactggaggcctcctgaggcagcgaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtttggagaaaaaaaaaaaaaaaaaaaaaaaaaaaa

SEQ ID NO: 1446 - DNA, 2400 bp, Homo sapiens
  ref <308>: DATABASE ACCESSION NUMBER: NM_014036
  ref <309>: DATABASE ENTRY DATE: 2001-06-18
tggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttccccagggtggcttcaatctccccacctaggatgtcagccctgtccaaggaccttccctcttctcccccagttccctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatgactcacttgtcaactagtggactaattaaccctccaccaaaaaaacacaaagtgcttctgtgagaccaattttgtgctaatgagcattgagactgatgctttgtaagtcacaccacaacaaatattgattgagggcgctgcatgtgctgggtacatttcttggcacttgggaatcagtagtcaagcgaaacccttgcctttgagagtttatggtctggataatataaataaacaagtaagcataaaaaaaaaaaaaaaaa

SEQ ID NO: 1447 - DNA, 1733 bp, Homo sapiens
  ref <308>: DATABASE ACCESSION NUMBER: NM_014062
  ref <309>: DATABASE ENTRY DATE: 2001-06-18
ctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactaccaaaaaaaaaaaaaaaaaa

SEQ ID NO: 1448 - DNA, 3115 bp, Homo sapiens
  Modified_base 1 ... 3115: n = a,c,g, or t
  ref <308>: DATABASE ACCESSION NUMBER: NM_014074
  ref <309>: DATABASE ENTRY DATE: 2001-06-18
cgcttttttnttttttttttttttttttgagacggagtcttgcactgttgcccaggctggagacagtggtgtgatcttggctcactgcagtctccacctctcaaattcaagtgattctcctgcctcagcctcccaagtagctgggattataggtgcccgccaccctgcctggctaatttttgtatttttagtaaagatggggttttgtaacattggccaggctggtctcaaactcctgacctcaactgaactgcccccatcgggcttccaaagtgttgggattagaggtctgagctactgggcccgggcaaacttggaaacatttttttccttcctagtgcctcagttttctcaaatgtaaaatgggaataaaatatctaccttgtaagacttttgtgagggtctaataactgttatatacattatctcatttaatcttcacaacaacctttaaaatagggatacgatcattctcaatttacagttgagtgaaagtgaggcagttcagatggcttgactaaggttacctggcatttgagtggcagagccaagatttaaacccagctctgtctgatgctagaccctttgcttcaaccatattctgtaatgtctcatttctaggaatgaatgaaggaatgttcacacatgtatcatccagcctctgaggtgcctctgacaaccataattgcctcctcatgaaaccgagcccagttcctcctgtggctcttcctgctgcagccgtgggccttgctctcctggctggaagcgctgttttcatcttatctggggattctcattgctgacggtgctggaggctgtggggcacagtggtttcaagcacaggctttggagtcaggcaaacctgggtttcaatatggctcaggaagctgttgggcaggaggacttttggtgagcaggcactgtctgataatggtgtttcccaggatcccaggtttcttgggggcacacaagtaggccaaagatgatctgggaacctcccagagaattgcctcatactgtactctccccaagaggctgcagccaagagaataggggccacgtcacgggggctcatgatggagtctgggctttgtgggaaaggaagtggggagggtctcagaaatgtttttacaatgtaaaatcttccagttagaactttatatgcaggatttaatcagaaggaaatttggacaggactcatttttctcattgctgctctaagtggctgctctaagcagtctggactgtctcccctgtggctttgttgagttcagtaaacatttattgtgcacatactgtgtgcaggcactttgctggggatacagggatgaaatagggacagtgcccatgcctgagggcattgccctgaagctggatgctaaggccatctgtgtgtgtgtctgtgtgtctgcatgtatctctgtgtctgcgtgtgtctctgtgtctgtgcttctgtgtctatgtgtatgtctgtgtgagtgtctgtgggtctctttttttgtgtttgtgtgtgtatctgtgtgtgtgttctctgtgtgcctgtatgtgtctttgatgtgtgtttctgtatgtgtctctgtgtgtgtctatatgtgtgtatctgtgtctatgtatgtgtgtgtcattttgtttgtttctgggtgtgtctacctctgcgtgtctctgtatacctgtatctccgtgtgtgtgtctgtgtgtgtgtatttgtgtgtctctgtatgtgcgtccgtgggtgtgtgtctgtgtgtgtgtgtgtgtgtattgagagggagggagaaagaaagggagcgacagatgggtcagcatggaaggtgtatcctcattcacagccctgggaggaatcagtcaatccacctactggtcaagaccaactctggtggtgcctggctgacagtgggaatgtgacttttcatttaagaatgggtttgcatttcctaggaaaagaatgtaggagttggagtctcaaggagtgttttttttttccttttgtgattgagagagcacagccttgtgtgcattggctgacagttaccaatctgcgtgttggggatagccacagagaagagacagagggaaccgcagacagtgagcaggagtctggtggaaccagtctgcctttaggcccaaacccccaactatgaatacctcaccttagggagctcagtcttttgtttgttcataaaaaaccaatctgggaaccagaggtggacaggaaagaggaggctgacctgctgctcccaggttaatgtgatcttggctggtgttgacaagtgtattatggttcatagcatagcacaaacccttagagattccccttgccctcaccggggtcaccacaccaaaccaggtatcttcaggagtgaggaccacaaaaaattggagatctcaccagggtgggcagagatttctttgttaaagtctgaaggagagaagactcaggggcatctctctggctccaaatctctgaagggccaaaggcagaagtgctgggggagtgtcaagttttcatttacaacagggacagcctgacagtggctgccttatgtggcagtgagtttcagtcaacagtcaacagaggcccaacgactactcaccaatgggaccaggtggccatagagggctggggagggcagagcaaggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaacctatcacctagcagataaaactatggggaaaacttaaatctgtgcatacatttctggatgcatttacttatcttcaaaaaaaaaaaaaaaaaaaaaaaaaaaaaaaaa

SEQ ID NO: 1449 - DNA, 839 bp, Homo sapiens
  ref <308>: DATABASE ACCESSION NUMBER: NM_014078
  ref <309>: DATABASE ENTRY DATE: 2001-06-18
tactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttgactaaaa

SEQ ID NO: 1450 - DNA, 1521 bp, Homo sapiens
  ref <308>: DATABASE ACCESSION NUMBER: NM_014096
  ref <309>: DATABASE ENTRY DATE: 2001-06-18
gaaaaaaatgcaatacaagaagcaagaccaaacagatatctaaacactacaaccacttctactacgaaaggccaaaacagcagacttgattgtgacatcaggtgacctagtaatcagctgtgtattctagctggtgcctctaccagcttcccatgtgaccttgaacatgtcattgaatgctcgctaggcctctgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacacaataaagacacacaaggacgtctgcgcagcaagaaaagaatctcagttgccaagcagattgatatcacacagactcaaagcaaaggcatgtggaacttctatatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1451 - DNA, 1934 bp, Homo sapiens
  ref <308>: DATABASE ACCESSION NUMBER: NM_014109
  ref <309>: DATABASE ENTRY DATE: 2001-06-18
ctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaata

SEQ ID NO: 1452 - DNA, 10011 bp, Homo sapiens
  ref <308>: DATABASE ACCESSION NUMBER: NM_014112
  ref <309>: DATABASE ENTRY DATE: 2001-06-18
ttcctccgcgaaggctcctttgatattaatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattctctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatttccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtatcaactagcattggaaaatacatatcactattcttggaatatttatggtcagtctactttttagtaaaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacaca

SEQ ID NO: 1453 - DNA, 918 bp, Homo sapiens
  ref <308>: DATABASE ACCESSION NUMBER: NM_014147
  ref <309>: DATABASE ENTRY DATE: 2001-06-18
ggggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtccccctgatcaccacctcaccaccctcatcctgatctcactgtacactccctttcctggtctgctaagtagcgggtgttttccttgacactaacgctacagctagaccacggtgggcttggcaacaggtgtcttcccagatgctggcgttaccgctagaccaaggagccctctggtggccccgtccgggcataacagaaagctcgcactcttgtcttctggtcactcctcactgtccccttcagcctcctatctctgtatggcctggtgtttcctaggttatgattgtagagcgaggattattataatattggaataaagaataattactacaaactaatgattaatgattcatatataatcatatctaagatctatatctagtataactattcttattttatatattttattatactggaacagctcgtgccctcggtctcttgcctcggcacctgggtggcttgctgcccacatccaccaagtgcactttgggaggctgaggctggaggactgctggaggccaggagttcaataccagcctgggcaacatagggagaccccccccccaccatctcc

SEQ ID NO: 1454 - DNA, 2610 bp, Homo sapiens
  ref <308>: DATABASE ACCESSION NUMBER: NM_014149
  ref <309>: DATABASE ENTRY DATE: 2001-06-18
ggctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatcccggacaccaaccccacctttgctacctacttttctcgacagtgggctgacaccttcattgtgtccctgcacacttcctgagcgtctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacttcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagcttcacacggagccagtggagccactgactcgggcatctcggcaggccctgagggtggaggagtccgcccgagcagccctttattgtgctggacaggaggagtacgggaacaccactcatccatcatgcactgcagagtggattgctctgggaggagagtcgcagcttagacgtagatggggtcatcaaagtgtggtccttcaaccccatcatgcaagaccaaagcatcttcatttcaaatcaccgctgctgtctttgaatggccaccaaacggacagactgctcttgctgggcagtggtgtgggaacagtgcgtctctatgacacggaagccaagaagaatctctgtgaaatcaatatcaacgacaacatgcccaggatcctgtctctgcgtgcagcccaacggggctctttagtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgacatgcagcagcatgagtgcgcgatgagctggagggcccactacgggaggtctactctgtggagttcagctatgatgagaacaccgtgtacagcatcggcgaggacggaagttcatccagtggaacatccacaagagtggcctcaaggtatccgagtacagcctccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgaagctaggtggccaccgagccctgtggtcaccgtggactggagcactgccatggactgtgggacctgcctcaccgcctccatggatggcaaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggc

SEQ ID NO: 1455 - DNA, 862 bp, Homo sapiens
  Modified_base 1 ... 862: n = a,c,g, or t
  ref <308>: DATABASE ACCESSION NUMBER: NM_014164
  ref <309>: DATABASE ENTRY DATE: 2001-06-18
agccaccgccgcgtccctctntccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacccgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgca

SEQ ID NO: 1456 - DNA, 615 bp, Homo sapiens
  ref <308>: DATABASE ACCESSION NUMBER: NM_014172
  ref <309>: DATABASE ENTRY DATE: 2001-06-18
ggggactccgggaggaggaacatggccgtggcggacctcgctctcattcctgatgtggacatcgactccgacggcgtcttcaagtatgtgctgatccgagtccactcggctccccgctccgggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagccccgcctttgcctgcactcctcttgcagggctggccctgcctgctcctgcggcagcctctggtgacgtgctgtccaccaggccttggagacaggctagcctggccacagaattaaacgtgttgccacacctgccggcttcttaaaaaaaaaaaaaaaaaaaaaaaaaaaaa

SEQ ID NO: 1457 - DNA, 1147 bp, Homo sapiens
  ref <308>: DATABASE ACCESSION NUMBER: NM_014175
  ref <309>: DATABASE ENTRY DATE: 2001-06-18
cacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaaaaaaaaaaaaaaaaaaaaa

SEQ ID NO: 1458 - DNA, 801 bp, Homo sapiens
  ref <308>: DATABASE ACCESSION NUMBER: NM_014181
  ref <309>: DATABASE ENTRY DATE: 2001-06-18
atacgggccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagtacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaaaaaaaaaaaaaaaaaaaaaaaaaa

SEQ ID NO: 1459 - DNA, 652 bp, Homo sapiens
  ref <308>: DATABASE ACCESSION NUMBER: NM_014184
  ref <309>: DATABASE ENTRY DATE: 2001-06-18
ggacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacaggaaaaaaaaaaaaaaaaaaaaaaaaaaaaaa

SEQ ID NO: 1460 - DNA, 3282 bp, Homo sapiens
  ref <308>: DATABASE ACCESSION NUMBER: NM_014211
  ref <309>: DATABASE ENTRY DATE: 2001-06-18
gggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttgtaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagacacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagagatgaaatgtggttgtatgagccaatcatatttgtgattttttaaaaaaagtttaaaaggaaatatctgttctgaaaccccacttaagcattgtttttatataaaaacaatgataaagatgtgaactgtgaaataaatataccatattagctacccaccaaaaaaaaaaaaaaaaaa

SEQ ID NO: 1461 - DNA, 1500 bp, Homo sapiens
  ref <308>: DATABASE ACCESSION NUMBER: NM_014214
  ref <309>: DATABASE ENTRY DATE: 2001-06-18
cggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 1462 - DNA, 3049 bp, Homo sapiens
  ref <308>: DATABASE ACCESSION NUMBER: NM_014216
  ref <309>: DATABASE ENTRY DATE: 2001-06-18
cccgcgggcaggggcggcgagtgcgcgggccgccgcccttctcggcgggcagcgcgcgaggaccaggccgaggaggaagtggcggcggcggcggcgggctccccgcccgaggaggaagatgcagacctttctgaaagggaagagagttggctactggctgagcgagaagaaaatcaagaagctgaatttccaggctttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcaacgccagccccggctgctgcggcagcatgatgggccaggacgcgccctggaaagctgaggccgacgcgggcggcaccgccaagctgccgcaccagagactcggctgcaacgccggcgtgtctcccagcttccagcagcattgtgtggcctccctggccaccaaggcctcctcccagtagccacggagccgggacccagagggcagcgcaggcgcaggagcacacccgctgggccagcagctcccaacggcgatgctactactaagaatccccagtgatctgattcttctgttttttaatttttaacctgattttctgatgtcatgatctaaatgaggggtagaagagagtaccaggtggtccaccgttggggagcggggccgtccgcctgctctctactgtgcagacctcctaactgagtttacacacgcttgtgttgcaacactaggtctggatgggaggtgaggggggtgcgtatactgccatgccagtgtctgtgcacatccctgtctgttgtctccatggccactgtggactgggacccttgaagcctgcccatgtgggtgtgggaggctgatcagtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcagggagttccgcgctggggtctgggctgtgctccctcactaaagggaaggaaaggaagctgggcgtcctccgggccccccaacacacgtcccatttagccctgcacagcggtctccttcccctaagccagcactgctgctccctggagccgggaaggaggctgcctggctggaggccgagccgatgggcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcgcccagcaggcctggtccacctctcattgcaagcccgcaagcactgagccgagtaaggtgcttagtgtgagccacccgccccccatagcttctgcacacctcagactcaccccatcaccttggcagcaaagcactgctctgccgtctgacccctgatccaggcagcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtcttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttc

SEQ ID NO: 1463 - DNA, 1003 bp, Homo sapiens
  ref <308>: DATABASE ACCESSION NUMBER: NM_014241
  ref <309>: DATABASE ENTRY DATE: 2001-06-18
tatacacagcccagccagcacccaggtccttccatccttctgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttgttggccaccgcctggctcaccttctacaacatcgccatgaccgcggggtggttggttctagctattgccatggtacgtttttatatggaaaagggaacacacagagggttatataaaagtattcagaagacacttaaatttttccaaacatttgccttgcttgagatagttcactgtttaattggaattgtacctacttctgtgattgtgactggggtccaagtgagctcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgtatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaa

SEQ ID NO: 1464 - DNA, 1622 bp, Homo sapiens
  ref <308>: DATABASE ACCESSION NUMBER: NM_014242
  ref <309>: DATABASE ENTRY DATE: 2001-06-18
tttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaaggtaaatgcaggaatgggtaatagtggtatcactacagaattgactctgaaatacattattactaatgttacaaccttagaaacaggtataagctctgtgaatgctgggcaagatgtgaacataattattacatataaaacatcactatagaataccaacttgggagatgtcgctaaaggacttcagtcaagtaattttggtgttaatatacaaacgtacaccccatctttaactccacagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagc

SEQ ID NO: 1465 - DNA, 11389 bp, Homo sapiens
  ref <308>: DATABASE ACCESSION NUMBER: NM_014246
  ref <309>: DATABASE ENTRY DATE: 2001-06-18
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactggagagcactgtgaggtggatgcccgctcaggccgctgtgccaacggggtgtgcaagaacgggggcacctgcgtgaacctgctcatcggcggcttccactgcgtgtgtcctcctggcgagtatgagaggccctactgtgaggtgaccaccaggagcttcccgccccagtccttcgtcaccttccggggcctgagacagcgcttccacttcaccatctccctcacgtttgccactcaggaaaggaacggcttgcttctctacaacggccgcttcaatgagaagcacgacttcatcgccctggagatcgtggacgagcaggtgcagctcaccttctctgcaggcgagacaacaacgaccgtggcaccgaaggttcccagtggtgtgagtgacgggcggtggcactctgtgcaggtgcagtactacaacaagcccaatattggccacctgggcctgccccatgggccgtccggggaaaagatggccgtggtgacagtggatgattgtgacacaaccatggctgtgcgctttggaaaggacatcgggaactacagctgcgctgcccagggcactcagaccggctccaagaagtccctggatctgaccggccctctactcctggggggtgtccccaacctgccagaagacttcccagtgcacaaccggcagttcgtgggctgcatgcggaacctgtcagtcgacggcaaaaatgtggacatggccggattcatcgccaacaatggcacccgggaaggctgcgctgctcggaggaacttctgcgatgggaggcggtgtcagaatggaggcacctgtgtcaacaggtggaatatgtatctgtgtgagtgtccactccgattcggcgggaagaactgtgagcaagccatgcctcacccccagctcttcagcggtgagagcgtcgtgtcctggagtgacctgaacatcatcatctctgtgccctggtacctggggctcatgttccggacccggaaggaggacagcgttctgatggaggccaccagtggtgggcccaccagctttcgcctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccagaacaaggcagatatcgggggcatgcttcccgggctgacggtaaggagcgtggtggtcggaggcgcctctgaagacaaggtctccgtgcgccgtggattccgaggctgcatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaagggtaccttggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgtacttctgcggtgctggtttttctccacaaacacccccgcccctccccatgcccagggtggccgtggaagggacggtttacggacgtgcagctgagctgtccgtgtcccatgctccctcagccagtggaacgtgccggaactttttgtccattccctagtaggcctgccacagcctagatgggcagtttttgtctttcaccaaatttgaggactttttttttttgccattatttcttcagttttcttttcttgcactgatctttctcctctccttctgtgactccagtgactcagacgttagacctcttgatgttttcccactggtccctgaggctctgttc

SEQ ID NO: 1466 - DNA, 2578 bp, Homo sapiens
  ref <308>: DATABASE ACCESSION NUMBER: NM_014268
  ref <309>: DATABASE ENTRY DATE: 2001-06-18
cgagcaggcggcaggcacggtccgtgcggagaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgctaaggtgtattagcggacggccctctggccacctacccgagagatcgtagggtcacattcatccaacttcaccacttggctgcttgagattggttctgctcttttcttcattcctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttccgaattatg

SEQ ID NO: 1467 - DNA, 3179 bp, Homo sapiens
  ref <308>: DATABASE ACCESSION NUMBER: NM_014272
  ref <309>: DATABASE ENTRY DATE: 2001-06-18
ccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccaagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggtctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccaggtgcctgcctcccgtggcccaggcggggggagcagaggcggagtccccaggcccagcaccctccatggcaggtctcgtcctggaggagtgagccctggttcagtcacagagcctggctctgagccaggccctcctgctgcggcctctacctcagtttccccatctttaaaatggcccaatcttgtagctgcagttcacagaggtggctggggtcaagctcctttaggactgggtggatggagaagacaccttgtgctcatgggcccccgcctgcccacccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgagaagtggggcaggcacagccccacctgcaggggcttagtgtctggacagggacactggcttcagctcccagctcactgctgggccaccacgggtttggaagtttgcttctctgagcctcagttctccatctgtgagatgaggctagcgattgccctgtgtcccaggcccgctgggagggtacatggatgaggcaggtgggtgctggctcgcggcgcatgttcagtgtgctccagctcttggcgttctccctccaggggacacagctccccctcgatagaccagtccagtggcccctcaccacactgacttatttccctaaactatttataaaaagtagggcaatttcattaactctgactctt

SEQ ID NO: 1468 - DNA, 757 bp, Homo sapiens
  ref <308>: DATABASE ACCESSION NUMBER: NM_014274
  ref <309>: DATABASE ENTRY DATE: 2001-06-18
gggccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctaaaaaaaaaaaaaaaaaaaaaaaaaaccc

SEQ ID NO: 1469 - DNA, 3568 bp, Homo sapiens
  ref <308>: DATABASE ACCESSION NUMBER: NM_014289
  ref <309>: DATABASE ENTRY DATE: 2001-06-18
atagttttcaggttaagaaagccagaatctttgttcagccacactgactgaacagacttttagtggggttacctggctaacagcagcagcggcaacggcagcagcagcagcagcagcagcagcagcagcagcagggctcctgggataactcaggcatagttcaacactatgggtcctcctctgaagctcttcaaaaaccagaaataccaggaactgaagcaggaatgcatcaaagacagcagacttttctgtgatccaacatttctgcctgagaatgattctcttttctacaaccgactgcttcctggaaaggtggtgtggaaacgtccccaggacatctgtgatgacccccatctgattgtgggcaacattagcaaccaccagctgacccaagggagactggggcacaagccaatggtttctgcattttcctgtttggctgttcaggagtctcattggacaaagacaattcccaaccataaggaacaggaatgggaccctcaaaaaacagaaaaatacgctgggatatttcactttcgtttctggcattttggagaatggactgaagtggtgattgatgacttgttgcccaccattaacggagatctggtcttctctttctccacttccatgaatgagttttggaatgctctgctggaaaaagcttatgcaaagctgctaggctgttatgaggccctggatggtttgaccatcactgatattattgtggacttcacgggcacattggctgaaactgttgacatgcagaaaggaagatacactgagcttgttgaggagaagtacaagctattcggagaactgtacaaaacatttaccaaaggtggtctgatctgctgttccattgagtctcccaatcaggaggagcaagaagttgaaactgattggggtctgctgaagggccatacctataccatgactgatattcgcaaaattcgtcttggagagagacttgtggaagtcttcagtgctgagaaggtgtatatggttcgcctgagaaaccccttgggaagacaggaatggagtggcccctggagtgaaatttctgaagagtggcagcaactgactgcatcagatcgcaagaacctggggcttgttatgtctgatgatggagagttttggatgagcttggaggacttttgccgcaactttcacaaactgaatgtctgccgcaatgtgaacaaccctatttttggccgaaaggagctggaatcggtgttgggatgctggactgtggatgatgatcccctgatgaaccgctcaggaggctgctataacaaccgtgataccttcctgcagaatccccagtacatcttcactgtgcctgaggatgggcacaaggtcattatgtcactgcagcagaaggacctgcgcacttaccgccgaatgggaagacctgacaattacatcattggctttgagctcttcaaggtggagatgaaccgcaaattccgcctccaccacctctacatccaggagcgtgctgggacttccacctatattgacacccgcacagtgtttctgagcaagtacctgaagaagggcaactatgtgcttgtcccaaccatgttccagcatggtcgcaccagcgagtttctcctgagaatcttctctgaagtgcctgtccagctcagggaactgactctggacatgcccaaaatgtcctgctggaacctggctcgtggctacccgaaagtagttactcagatcactgttcacagtgctgaggacctggagaagaagtatgccaatgaaactgtaaacccatatttggtcatcaaatgtggaaaggaggaagtccgttctcctgtccagaagaatacagttcatgccatttttgacacccaggccattttctacagaaggaccactgacattcctattatagtacaggtctggaacagccgaaaattctgtgatcagttcttggggcaggttactctggatgctgaccccagcgactgccgtgatctgaagtctctgtacctgcgtaagaagggtggtccaactgccaaagtcaagcaaggccacatcagcttcaaggttatttccagcgatgatctcactgagctctaaatctgcaatcccagagaatcctgacaaagcgtgccacccttttattttccgtcaggtgccaggtcttagttaagattcacaatctttagaaagaatgagattcacaataattaactcttcctctcttctgataaattccccatacctcccaatccaagtagcatctgtagctacataacctatatacctccagcagctggacatggggaggcgacagtcctatctagacatcatacacatttgccaagaaaggatctctggggcttccgggggtgagattcaagcaggacaataacaagaggctggacaccctacagatgtctttgatgttttcagttgtttgatatatctcccctgtagggcatgttgaggaaggaggagggctgatcaaggccaagctggtctagcctgacatcctagctcctgactgaacactatagacttcccagcagcatttcacccagcagccagagccggctttaagtccccaacccttacagacaccactgccaccaccaccaaccacgaccaccaccaccaccaccactcaccaccatcatcacctccggaaagtgtagtcctgccctaacccaagtcacccccgacagtaaattttaccttcatgttgagaaagcttcctggtgcttaatcaagagctggagttcaatgagtcctagacagtgagaggggcctgagcttcagctcaatggaagcctgctgtgtgccacaagacggaaaagtggaagaagctgcagtgggagacaaagcctcggtcccccacccatccacacacacctacactcacacacgcgcacatgggcgcgcacgaactaccattcaggcagtcagtgggcaagaggaaagataagtaagtaccatacacacctaaaagatgagagaattcatccagacatattacagccagtttggggcccctgactgcaatgtgaaacctctcgctgctgctaggtttacaaacaagcccattgtcctgtgcctcctaatatcatttgtactgaagaccccatctggggacttgagactttggtcccagcccagactcctcagacttttctctcagttgggatgcttcactcgctgggggtgtttgtttgccctctcatttttcagtacttctacagaattttctctagagtcagtcattatgaaatgtacttccctccatcttaacctatcaactttctgcccctccttcaaggcccagtataaatgccacctcctccatgaagccttccctaattccaccccaaacccccaccttcaacaatatttcaacgcttctgcaatgatgaaaaagaaacatagttgtagtacttagcctacctagaccagcaagcattcatttttagctcgctcattttttaccatgttttccagtctgtttaacttctgcagtgccttcactacactgccttacataaaccaaatcacaataaagttcatattcagtaca

SEQ ID NO: 1470 - DNA, 1182 bp, Homo sapiens
  ref <308>: DATABASE ACCESSION NUMBER: NM_014298
  ref <309>: DATABASE ENTRY DATE: 2001-06-18
gtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatgttgaaggataaccatgtggtgccccccggtggcgtggagaaggcggtgcgggcggccagacaggcggctgacttcgctctgaaggtggaagtggaatgcagcagcctgcaggaggtcgtccaggcagctgaggctggcgccgaccttgtcctgctggacaacttcaagccagaggagctgcaccccacggccaccgcgctgaaggcccagttcccgagtgtggctgtggaagccagtgggggcatcaccctggacaacctcccccagttctgcgggccgcacatagacgtcatctccatggggatgctgacccaggcggtcccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtgaacaatggggcacatttggcactagcttgagcccaactctggctctgccacctgctgctcctgtgacctgtcagggctgacttcacctctgctcatctcagtttcctaatctgtaaaatgggtctaataaaggatcaaccaaaaaaaaaaaaaaaaaaaa

SEQ ID NO: 1471 - DNA, 482 bp, Homo sapiens
  ref <308>: DATABASE ACCESSION NUMBER: NM_014302
  ref <309>: DATABASE ENTRY DATE: 2001-06-18
tcgacccggattccggttccggtgggctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaaataaaaaaaaaaaaaaaaaaaaaaaaaaaaaa

SEQ ID NO: 1472 - DNA, 3065 bp, Homo sapiens
  ref <308>: DATABASE ACCESSION NUMBER: NM_014314
  ref <309>: DATABASE ENTRY DATE: 2001-06-18
tagttattaaagttcctatgcagctccgcctccgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgaagagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtccctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaataaaaaaaaaaaa

SEQ ID NO: 1473 - DNA, 1721 bp, Homo sapiens
  ref <308>: DATABASE ACCESSION NUMBER: NM_014315
  ref <309>: DATABASE ENTRY DATE: 2001-06-18
agacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcaggtatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacc

SEQ ID NO: 1474 - DNA, 722 bp, Homo sapiens
  ref <308>: DATABASE ACCESSION NUMBER: NM_014316
  ref <309>: DATABASE ENTRY DATE: 2001-06-18
cagggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacaggtccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgaggagactttgcggggaggaggcagcagacactggagatgacattcttccacacgagacggggcttcagccggggatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggaaaaaaaaaaaaaaaaaa

SEQ ID NO: 1475 - DNA, 1630 bp, Homo sapiens
  ref <308>: DATABASE ACCESSION NUMBER: NM_014317
  ref <309>: DATABASE ENTRY DATE: 2001-06-18
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgggccggggccgcgcgccgctgccgatgcccgcgcaggctcataggcagaagggacttgacttgtctcagataccctattttaatcttgtgaagcatttaacacctgcctgtccaaatgtatatagtatatcacagtttcatcacacaaccccgtacagcaaaacacacagtggtgagaaatacaccgatcctttcaaactcggttggagagacttgaaaggtctgtatgagggtattagaaaggaacccctcatatcaacaacagaacttaaggaaatctctgagtactactttgatgtaaaaggaaaagcctttagaccgattattgtggtgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaaggtttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaaaaaa

SEQ ID NO: 1476 - DNA, 1137 bp, Homo sapiens
  ref <308>: DATABASE ACCESSION NUMBER: NM_014320
  ref <309>: DATABASE ENTRY DATE: 2001-06-18
ctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatc

SEQ ID NO: 1477 - DNA, 1635 bp, Homo sapiens
  ref <308>: DATABASE ACCESSION NUMBER: NM_014321
  ref <309>: DATABASE ENTRY DATE: 2001-06-18
ggcacgagcgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgcaaaaaaaaaaaaaaaaaaaa

SEQ ID NO: 1478 - DNA, 2352 bp, Homo sapiens
  ref <308>: DATABASE ACCESSION NUMBER: NM_014325
  ref <309>: DATABASE ENTRY DATE: 2001-06-18
cagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaaccc

SEQ ID NO: 1479 - DNA, 1719 bp, Homo sapiens
  ref <308>: DATABASE ACCESSION NUMBER: NM_014335
  ref <309>: DATABASE ENTRY DATE: 2001-06-18
cgcacggccgcgcagatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtaaaaaaaaaaaaaaaaaaaaaaaaaaaaa

SEQ ID NO: 1480 - DNA, 11490 bp, Homo sapiens
  ref <308>: DATABASE ACCESSION NUMBER: NM_014363
  ref <309>: DATABASE ENTRY DATE: 2001-06-18
atgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagccggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacaatcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcactggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtga

SEQ ID NO: 1481 - DNA, 1274 bp, Homo sapiens
  ref <308>: DATABASE ACCESSION NUMBER: NM_014364
  ref <309>: DATABASE ENTRY DATE: 2001-06-18
aggtccaggccaatgataaccttataagaggccatgtcgaagcgcgacatcgtcctcaccaatgtcaccgttgtccagttgctgcgacagccgtgcccggtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtgaaacgggaaggtcct

SEQ ID NO: 1482 - DNA, 2010 bp, Homo sapiens
  ref <308>: DATABASE ACCESSION NUMBER: NM_014365
  ref <309>: DATABASE ENTRY DATE: 2001-06-18
gccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcacgaggccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 1483 - DNA, 1749 bp, Homo sapiens
  ref <308>: DATABASE ACCESSION NUMBER: NM_014373
  ref <309>: DATABASE ENTRY DATE: 2001-06-18
gtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagacgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgtaagcaagaaaaaaaaaa

SEQ ID NO: 1484 - DNA, 3637 bp, Homo sapiens
  ref <308>: DATABASE ACCESSION NUMBER: NM_014382
  ref <309>: DATABASE ENTRY DATE: 2001-06-18
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaataagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatactgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttctt

SEQ ID NO: 1485 - DNA, 2950 bp, Homo sapiens
  ref <308>: DATABASE ACCESSION NUMBER: NM_014395
  ref <309>: DATABASE ENTRY DATE: 2001-06-18
gcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagacctggaaaacaagatggtttactctgcacaggaatgaactgaaatacttcaaagaccagatgtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattggtcaaggacaaaagctgtattttgtctgctctctgtatatctcccgaggagaagactgatcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaagaacatttccaaaactaaaatagaaaatgcttgtggcatttattttctctttttaaaaggttcagaaatttggcaggtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaagttatctttatccaacatttctccaaatggactgaaagaaacttttcaaggacagtgtattataacaatccctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagttaaaatgtattgtgttgtttgtaaagtaagaagttactggccaggagcggcggctcatgcctgtaatcccaggactttggtaggccaagacaagcagatcacttgaggtcaggagttcaacatcagcctggccaacatgatgaaaccttgtctttactaaaaatacaaaaattagctgggcatggtggcaggcgcctgtaatcccagctactcaggaggctgaggcaggagaattgcttgaacccgggaggtggaggttgcagtgaaccaagatcgcggcgctgcactctagcctgggtgacagagtcagactccgtcccaaaaaaacaaacaaacaaaacaaaacaaaaaaaacagaagttacaaatgaatactcacggatatgtatagttttatgtttgttttcttagaaacaaatgtgtttctttgggtgggtaatattgtgttttactatgtttaccttttataaaacataacctgtttatttatattctttggctttgtttattaaaaagcatgattttgctgtgcatgtaccattttg

SEQ ID NO: 1486 - DNA, 3178 bp, Homo sapiens
  ref <308>: DATABASE ACCESSION NUMBER: NM_014398
  ref <309>: DATABASE ENTRY DATE: 2001-06-18
ggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacagctggaaccagttcatcaaccgtcagccacacaactgggaacaccactcaacccagtaaccagaccacccttccagcaactttatcgatagcactgcacaaaagcacaaccggtcagaagcctgatcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacgggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaattgctagactaagaattaggtggctacagatggtagaactaaacaataagcaagagacaataataatggcccttaattattaacaaagtgccagagtctaggctaagcactttatctatatctcatttcattctcacaacttataagtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgcaataaaaacttactttgg

SEQ ID NO: 1487 - DNA, 1831 bp, Homo sapiens
  ref <308>: DATABASE ACCESSION NUMBER: NM_014399
  ref <309>: DATABASE ENTRY DATE: 2001-06-18
gccgcgccgcccgcacgtggcagccccaggccccggccccccacccacgtctgcgttgctgccccgcctgggccaggcccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatggataatttacttgtgtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaaaaaaaaaa

SEQ ID NO: 1488 - DNA, 428 bp, Homo sapiens
  ref <308>: DATABASE ACCESSION NUMBER: NM_014402
  ref <309>: DATABASE ENTRY DATE: 2001-06-18
aaaaataagtaggaagtgctcaattttaatttggttcagttttccggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaggatccagctgcctatgaaaatgacaaatgagcaacgcatccggatgacggttccctgtctctgaaagacctttctctggaagaggagtctgcattgtagtgtctcaaagacacaataaacttcctatggtctg

SEQ ID NO: 1489 - DNA, 2859 bp, Homo sapiens
  ref <308>: DATABASE ACCESSION NUMBER: NM_014428
  ref <309>: DATABASE ENTRY DATE: 2001-06-18
atgaacctgtgtggcctcatgcccatcttccccgctcccctcgaccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggaaggcgtgaccatggctgatgagatgtcctctccccctgcagacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtga

SEQ ID NO: 1490 - DNA, 2219 bp, Homo sapiens
  ref <308>: DATABASE ACCESSION NUMBER: NM_014448
  ref <309>: DATABASE ENTRY DATE: 2001-06-18
cccatttcaggtgggacttgtggcataggagaggtcttgggactggtgcccagcctggtgcagtcccctcccaaagcctccctctcccacacagccgtgagagcctgtgggcctagaggactcagctggcaggttgcagggaggcgcagccttttgcaatcccccagggccacaggttaccctccttctctctctagacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccggaggtggtggaattgggcatcctggaccagctctccactgaggagcggaaaaggcagagggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagtacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctccgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtagagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtaggcctggcgaggccagccggcggcagcacagcctgtccccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctctcagctgctgggccccacctccccactgcacccaggggacaactccacctggactgatgggcacaggaggcaccaatagcgattattgggggcaatgcgaggtctcctcctatgcccttcctacccctgagtgggacaagaagggccttgagtgcccaggagtgccccacgttctgagaaggggccggccggagggaggggacccggcagggagatttcggttttgaggtttctaaatacattaaagttatttcttaag

SEQ ID NO: 1491 - DNA, 1514 bp, Homo sapiens
  ref <308>: DATABASE ACCESSION NUMBER: NM_014449
  ref <309>: DATABASE ENTRY DATE: 2001-06-18
gagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatgg

SEQ ID NO: 1492 - DNA, 1232 bp, Homo sapiens
  ref <308>: DATABASE ACCESSION NUMBER: NM_014450
  ref <309>: DATABASE ENTRY DATE: 2001-06-18
gccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggccggagcaggagccatccggggcagggacgctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggctgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtcccaagttttcaaataaaactttccaaaaaagtg

SEQ ID NO: 1493 - DNA, 1968 bp, Homo sapiens
  ref <308>: DATABASE ACCESSION NUMBER: NM_014452
  ref <309>: DATABASE ENTRY DATE: 2001-06-18
atggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtag

SEQ ID NO: 1494 - DNA, 903 bp, Homo sapiens
  ref <308>: DATABASE ACCESSION NUMBER: NM_014453
  ref <309>: DATABASE ENTRY DATE: 2001-06-18
cggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgttatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacactaaaaaaaaaaaaaaaaaaaaaaa

SEQ ID NO: 1495 - DNA, 1626 bp, Homo sapiens
  ref <308>: DATABASE ACCESSION NUMBER: NM_014456
  ref <309>: DATABASE ENTRY DATE: 2001-06-18
agcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggatgggcgatccagatctgggaaaggaaggggactaccaaagaaaggtggtgcaggaggcaaaggtgtctggggtacacctggacaggggtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagtttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttggaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttgggta

SEQ ID NO: 1496 - DNA, 1722 bp, Homo sapiens
  ref <308>: DATABASE ACCESSION NUMBER: NM_014476
  ref <309>: DATABASE ENTRY DATE: 2001-06-18
gcggccggtcgaccggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaggatttaaaaaaaaaaaaaaaaaaaa

SEQ ID NO: 1497 - DNA, 2187 bp, Homo sapiens
  ref <308>: DATABASE ACCESSION NUMBER: NM_014479
  ref <309>: DATABASE ENTRY DATE: 2001-06-18
cgcccgggcaggtgagaaattggagaagataaaactggacactggggagaccacaacttcatgctgcgtgggatctcccagctacctgcagtggccaccatgtcttgggtcctgctgcctgtactttggctcattgttcaaactcaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcgagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 1498 - DNA, 890 bp, Homo sapiens
  ref <308>: DATABASE ACCESSION NUMBER: NM_014501
  ref <309>: DATABASE ENTRY DATE: 2001-06-18
ggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 1499 - DNA, 5145 bp, Homo sapiens
  ref <308>: DATABASE ACCESSION NUMBER: NM_014521
  ref <309>: DATABASE ENTRY DATE: 2001-06-18
cgggcccctcgccactaccgccgccgccgccgccgtgagtcccgcggagccgcgcgcgcccccggctgggccgagccgctggccgacgagcggagcctcaggagccggcggggacgccatgcgagccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaaaaaaaaaaaaaaaaaaaaaa

SEQ ID NO: 1500 - DNA, 2250 bp, Homo sapiens
  ref <308>: DATABASE ACCESSION NUMBER: NM_014552
  ref <309>: DATABASE ENTRY DATE: 2001-06-18
ccgccgctccggacccgcagccgccgccgccgcctcctccccccggatcgggtgtactgtcctaacccgaaagtccagttctgcggcccggcagcggcgagcgggcgcgatgacacaggagtacgacaacaaacggccagtgttggctcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagcctcatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacaga

SEQ ID NO: 1501 - DNA, 4909 bp, Homo sapiens
  ref <308>: DATABASE ACCESSION NUMBER: NM_014553
  ref <309>: DATABASE ENTRY DATE: 2001-06-18
ttcggagcgcgaagccgccgctgggacctcggcgcgccccgcgtctgcgcttgctgccgcgccccggtcggcgcgctgggagttccagccatgctcttctggcacacgcagcccgagcactacaaccagcacaactccggcagctacctgcgtgatgtgctcgctctgcccatcttcaagcaggaggaaccccagctgtcccccgagaacgaggcccgcctgccacccctgcaatatgtgttgtgtgctgccacgtccccagccgtgaagctgcatgaagagacgctgacctacctcaaccaaggtcagtcttatgaaatccgactactggagaatcggaagctgggagactttcaagatctgaacacaaaatatgtcaagagcatcatccgtgtggtcttccatgaccgccggctgcagtatacggagcaccagcagctggagggctggcggtggagtcggccaggggaccggatcctggacatcgatattccactgtctgttggtatcttggaccccagggccagcccgacccagctgaatgcagtcgagtttttgtgggaccctgcgaagagagcttctgcattcattcaggtacactgcatcagcacagaattcacccccaggaagcacgggggcgagaagggagtgccctttcgagtccagattgacacgtttaagcagaacgagaatggggagtacacggagcacctgcactcagccagctgccagatcaaggtgttcaagccgaagggagccgatcggaaacagaagactgaccgggagaagatggagaaaagaactgcccaagagaaggagaaataccagccgtcctatgaaaccaccatcctcacagagtgctctccatggcccgacgtggcctaccaggtgaacagcgccccgtccccaagctacaatggttctccaaacagctttggcctcggcgaaggcaacgcctctccgacccacccggtggaggccctgcccgtgggcagtgaccacctgctcccatcagcttcgatccaggatgcccagcagtggcttcaccgcaacaggttctcgcagttctgccggctctttgccagcttctcaggtgctgacttgctgaagatgtcccgagatgatttggtccagatctgtggtcccgcagatgggatccggctcttcaacgccatcaaaggccggaatgtgaggccaaagatgaccatttatgtctgtcaggagctggagcagaatcgagtgcccctgcagcagaagcgggacggcagtggagacagcaacctgtctgtgtaccacgccatcttcctggaagagctgaccaccttggagctgattgagaagattgccaacctgtacagcatctccccccagcacatccaccgagtctaccggcagggccccacgggcatccatgtggtggtgagcaacgagatggtgcagaacttccaagatgaatcctgttttgtcctcagcacaattaaagctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctgaaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggaggttagggggatggtaatagaaaaagactattttatttcctggcaatcacgggtaaggaggattaggaatgagtattccattcctaggtgtcatcagatgaccttgaccaccacaataccaggccctcttggatggacttatagaaagttagagaagaccttgttgaaccgctgctaaacttgccacaggagcgatgtgttttctctgagtgcccctcacttacatgtttatctttgtttgtagaggctatgtttaggatattttgcctgcatcagaatgggtgcatcatctttcttaatggcctatcgggaaatttgagtgtcagtaactgtggtagactcagaaattcgtctttgtcttgcctctggttcctgggatccagtgatctctactggcccagggcttcagctcttggttaatttaggttcatggggaaccctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccatggcattcctacagaacagagtgaggacaggctcctgattcctcttccttctttagagagaagcggggagtgggttaactaacagctttattgagatgtcattcacatgccattcagtttacccattgctagtgtccaattgtattcacagaaccaccatcaattcacagaattacagtcaacgttggtacattttcatcacccccagtaaaaccccgtacccttggtctgtcactcctgctttcctaactcctgcagtccaaggcagccatgaatctactttctatgtaagattaacctactctggacatttcatatatctggaatcatgtgatatctcttttgtgactggcttcttccactgaatgttttctagggccgtccaagttgaggatgtatcagtacttcattcttttgtattgctgaataatacttcattgtatagatagaccacatttgtttattgattcatcagttgatggacatttgtgtgtttttactttttggctactctgaatgatgctgctatgaacatatttctacaagattttgtgtggacatatgttttcatttcttttagcaatatacataggagtggaattgctaggtcttacagtaactccgtgttttaactttttgagaaactgccagactgttttctatagcagctgtaccattttacattcccaccagcaatgtatccaggtttcaatttgtctacatcctcatcaacacttgctattatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtcttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaacttgtatagttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttacctttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttacct

SEQ ID NO: 1502 - DNA, 2030 bp, Homo sapiens
  ref <308>: DATABASE ACCESSION NUMBER: NM_014570
  ref <309>: DATABASE ENTRY DATE: 2001-06-18
ggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaa

SEQ ID NO: 1503 - DNA, 2112 bp, Homo sapiens
  ref <308>: DATABASE ACCESSION NUMBER: NM_014575
  ref <309>: DATABASE ENTRY DATE: 2001-06-18
cggctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaacccg

SEQ ID NO: 1504 - DNA, 2443 bp, Homo sapiens
  ref <308>: DATABASE ACCESSION NUMBER: NM_014585
  ref <309>: DATABASE ENTRY DATE: 2001-06-18
agctggctcagggcgtccgctaggctcggacgacctgctgagcctcccaaaccgcttccataaggctttgctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgarcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaggactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggraaaaaaattggraaaaggaaaaactcagttttaaatacgggagactataatggataacactgrattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatc

SEQ ID NO: 1505 - DNA, 970 bp, Homo sapiens
  ref <308>: DATABASE ACCESSION NUMBER: NM_014595
  ref <309>: DATABASE ENTRY DATE: 2001-06-18
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcaacgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagacaccgttaagcgctgtgctaccgggccccaggcccagccacccggtacctcccgagaggctgtccctggaccctggctggcatggaaatacagtgggaaaaccagtcgggacctttaataaaagaccttggctttctaaaaaaaaaaaaaaaaaaaaaaaaaaaaaa

SEQ ID NO: 1506 - DNA, 2366 bp, Homo sapiens
  ref <308>: DATABASE ACCESSION NUMBER: NM_014597
  ref <309>: DATABASE ENTRY DATE: 2001-06-18
ggcacgagcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgatgaatcacagaccactgggaagcaaagtttaatccctagaactcctaaagctagaaagagtaagagcagaactacaggctcactaccaaaggggactgaaccatctacggatggagagacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagactgctggctgattctgaattcagagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaaaa

SEQ ID NO: 1507 - DNA, 470 bp, Homo sapiens
  ref <308>: DATABASE ACCESSION NUMBER: NM_014624
  ref <309>: DATABASE ENTRY DATE: 2001-06-18
gggaccgctataaggccagtcggactgcgacatagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacacctctgggggtcctctctgagtcaaatccagtggtgggtaattgtacaataaattttttttggtcaaattt

SEQ ID NO: 1508 - DNA, 4243 bp, Homo sapiens
  ref <308>: DATABASE ACCESSION NUMBER: NM_014633
  ref <309>: DATABASE ENTRY DATE: 2001-06-18
gtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttacc

SEQ ID NO: 1509 - DNA, 4831 bp, Homo sapiens
  ref <308>: DATABASE ACCESSION NUMBER: NM_014640
  ref <309>: DATABASE ENTRY DATE: 2001-06-18
gccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctcagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccatcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaagtgagccatgtgtggtttgtctgggggccctggtgtggttgctgagttgtagctcaagaggagaaaacatacagaacatatttggaccggaaatcctttgttctgaatttgagggggtcttctgaggtccttatttccttaggtctttcctcacccctctcccaccgctgtcctgaggagaaacccttgaacttcctcagtagacaggcggagaggccacaacatgccgaacccatttcctgtcatcctagtcttgggtcttcaccgcctccttccaaatacccaccctgccagcagccctaggtcttcctgttctgaccccccatcactgctcgttcagccttctagacgtctctctcgtggacatctgttctttagctgttggctttctctgaggtgtgagagggtctatgaactttgtgaatttcccatggccccagtgaaggagcccagataatcccagtagctgttacctgtctccatgtatcaaaggacacagtccagggggagggtggaaggagatgtggtttctctatagtgcaacaaacatggtttctcaatgttctgctgtgcagcaagcagggtctggcggcttggtaggtgggtttcaggagcagtcactattgtaggatgggcttccaatcaaacctcagactaaactcttgtactgaactgattctacctccctcctctagactcagtaaacagtgactattcaat

SEQ ID NO: 1510 - DNA, 2535 bp, Homo sapiens
  ref <308>: DATABASE ACCESSION NUMBER: NM_014642
  ref <309>: DATABASE ENTRY DATE: 2001-06-18
cgctgtagtgcggcgccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatattacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 1511 - DNA, 6033 bp, Homo sapiens
  ref <308>: DATABASE ACCESSION NUMBER: NM_014643
  ref <309>: DATABASE ENTRY DATE: 2001-06-18
cggggcgtgcgcgtcctcctccccaggcccgccgcctccctgccaagaatctgagagaggccgagtggagttcggtccttctctgaacagttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgtccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctctgcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttctttctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgtgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccagtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtg

SEQ ID NO: 1512 - DNA, 4564 bp, Homo sapiens
  ref <308>: DATABASE ACCESSION NUMBER: NM_014656
  ref <309>: DATABASE ENTRY DATE: 2001-06-18
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 1513 - DNA, 5285 bp, Homo sapiens
  ref <308>: DATABASE ACCESSION NUMBER: NM_014668
  ref <309>: DATABASE ENTRY DATE: 2001-06-18
gatgtcttggacatgctctggctggctaatctccatgttctagccgactgaaaatacggtggccaagtggatggtgtgcttatttgcagtctaaagaaatttccttttgatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgatctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 1514 - DNA, 2681 bp, Homo sapiens
  ref <308>: DATABASE ACCESSION NUMBER: NM_014669
  ref <309>: DATABASE ENTRY DATE: 2001-06-18
cggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgctttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 1515 - DNA, 1219 bp, Homo sapiens
  ref <308>: DATABASE ACCESSION NUMBER: NM_014673
  ref <309>: DATABASE ENTRY DATE: 2001-06-18
gggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgc

SEQ ID NO: 1516 - DNA, 6471 bp, Homo sapiens
  ref <308>: DATABASE ACCESSION NUMBER: NM_014675
  ref <309>: DATABASE ENTRY DATE: 2001-06-18
ggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggccgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtggccgacagcgaggtgaaggcagggaccctgcagctgaccgtggagcggctgaatggggccctggccaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgttttt

SEQ ID NO: 1517 - DNA, 2913 bp, Homo sapiens
  ref <308>: DATABASE ACCESSION NUMBER: NM_014679
  ref <309>: DATABASE ENTRY DATE: 2001-06-18
acgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaacagagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatttg

SEQ ID NO: 1518 - DNA, 6962 bp, Homo sapiens
  ref <308>: DATABASE ACCESSION NUMBER: NM_014680
  ref <309>: DATABASE ENTRY DATE: 2001-06-18
cgcgatgggcacctgcagcatcggtctggggagaacagcattcgagctgccgggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatat

SEQ ID NO: 1519 - DNA, 7724 bp, Homo sapiens
  ref <308>: DATABASE ACCESSION NUMBER: NM_014696
  ref <309>: DATABASE ENTRY DATE: 2001-06-18
gtgggggacaatgaggatgcaggcacactgggcaagagggggttaaatgtcaggcaggataggtctgattgatggtactgggtgggcatcttatctcactgctgcaccatccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccaactgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactgccttgcatatggttctgaccagtcaggcaggctgggactgaaggtggctccctggtgaacctagcgctgtgggagttcatagtagaatcggcttaggtgctgccacccaactcaactccactccctccctttctctcttctgcaggcagccatgagctccagccaccccgagccgggtccctgggcacccctgagcccccgccttcagcccctgtcccagagctcttccagcctgctgggtgaaggccgggaacagaggccagagctccacaagactgccagcagcaccatgtggcaggcccagctgggcgaggccagcaccagaccccaggccccggaggaagaggggaacccgcctgagagcatgaagccagcacgggcctctggccccaaggcgcgacccagtgctggaggccactggcggagcagcactgtgggcaatgtgtccaccatgggcggtggtgacctttgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcggtgccaccactagacctgggggacacaactgcccacagcagcagtgcccaggctgagcccaaagctgctgaacagctggctaccaccacctgccatgctctgcccccagctgctctactctgtggcatgagggagatgagggaggtgggggctggtggctgctgccatgccctacctgccacagggatcctggcctttcccaaactagtggcgtcagtgagcgagtctgggctgcaggctcagcatggggtgaagatccactgtaggttgtctggggggctccctgggcactcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggcgccgtcccctgtgcgggatgtgcgatgggatgctgagggcatgacatgggaggtgtacggagctgcggtggacccggaggtgctcggtgtggccatccagaagcacctggagatgcagtttgagcagctgcagcgggcgcctgccagcgaggacagcctgtctgtggagggccggagggggccgctgcgggctgtcatgcagtccctgcggcgccccagctgctgcggctgctctggcgcggcccccgagtgaggagctgtggcccttggagctggcctgggcccactgacttagtcctagacctgggccagggacagtgggggctccgtgccccctggacccaccggcagctgggcacatgtctcacccgaatatcggctgcctccagaccacaggactgcagcctggggcttccggccccacacagctgggctgttttcttaagggcttgatttccaagggccacatctctgcaccttccaggctctgaactttgagacagggctttagcactgtgcagaggggagatcctgagttttctttaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccggctgagccgagggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatgacaggggaggatgctgaccattacggagggctgccaggcttccagggtcattgtgtcagaggctggtctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtggggctcgcttgcccacatgacctgacctaggctaggcagtgggggccaggggccttggagagacagaaacatgggggtttggcacagtctgacttcattgcccaaagatttctcaaggcctgtgaagaatgggagtgggcttgtgttcttgtcctgggtctttgtcttgaagatcctaagatcccgtgactcagccccccaatccacccttgtgagggaccagagggctagtgtggggtcatggcccatgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacctgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggtcacatgagagagaacaaatggctgtgggtacatggggagggacctttcacacagggccatagctaagtagggtcttgaggatgcaggggttagacaggtgggtggagagagggcaggacctgcccggcagatggaacagcctggtcagatacttggatgtgcctgtcctgcccgggccatgatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggacaaggtgaatggcatgttcagcaggtgcagaaagggccacatgccacagggtttggctgggaccagtgaaacctacttcatgaagagactttcttctgtgtcacatgcagattctcatgcattcacgctggctgggtgccactctgtgctacctccatgctgccctggcttgccaggatggcaggccgggctgggctcagccaagctcccactcacctcatcatcactgagatgagtatttgcagagcggtgctggaatccaacacctgtgtcttggctggggccccagacgattctcctggctaaaccacgatccttgtctccctagcccagttgcacagctgctgctgacaggtctacctgaagtgactgcagcctcatttctgattggaactggagacccctcccaaccccccttgctgtgccctctcctgggacaggcctgatgcctgcagtggtttagggccccagagcatggccagcggtttagtttacagatctcctccccttggactctagatttctggccagactttctgggtccctttcaggccctgctctgggaggtgttggagttcactgttgatgtgtttgtttggctttgaattcaaaatagatacaaatttggaggtgagagctttgccagaccccagcagggatggggcatcggtcctggctggtcttgtttattttgtcctggtaaattctgttctctggagcataaaccgtggagtcctagagccccttgtctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacatgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacatttaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcactgaggagggctaccctagccctcaccactcatcttgggctgggttccccagaagcttctgctgagatgaggatgctggagttattagggaggggagagcaagttaagggagggacagaaggcaaggcagggtgtgatttcagtccaagccagaccctaaaggggagccctggatgcagtcccacctcagagtaaggactacccaggggtgaagatgtagcctccaggcacttctgctctctggcaggcaggctaggaagctctaggagccccagggtaggtttctgcatggagttgtagggcctattttgggggaagttgtgcacagaaaccaccagagggagtcacaggcatctgggggtgcacccattgacatttgcatccatgtcatgccaaacttgtagcccacaaatgcccaacccttttctccatgcattgctctgtctcagttttgttcacgccaagcagccttggttagttaaatgcagagcttggcatttgcccatgttaaattccttctcctttttcattctggcctggcctggttttgccatctgaagctatgatgagtcctttatcagttttcatccaacttgtcaggcagggcagggctggtatgaagcccaggacatatcgctgggacatcccataggtctgtgagattcccaggtccctccaaatccacacggtcatcatgggcaaattagtttaagtctgatctgttaagatccagatctctcacaccaacagcacacacccctttttcccatggccatggaaggagggtagcatagcctgactcgagtcctcgttctcagcagaactggttctgtggtggccacttccctttctcaacttttacctacttctgtttaataggttgttctgcaagtctgagagcaacggcaagcttagaagtgtggactcggcctggtacagtggctcatgcctgtaatcccagcactttgggaggctgaggtgggctgactgcttgagctcaggagttcaaaaccagcttgggcagcatggcgaaatcccatctctacaaaaaatacaaaaattagctgggcatggtggtgtgcatctgtagcctcagctactcagggggttgaggtgggaagatggcttgagcccaggaggtggaggttgcagtgagccgagatagtgccactgtgctccagcctggatgacggagccagatcctgtttcaaaaaaagaaaaagacaagaaagaagtatggactctaccttcttgcccttgtggagattgggaactgcctgcccttggcctctttcctgtccatcttgtattatgaaaggctgtttctggcacacccgggctcctctgtgtggtttctgggaagtgactgagggtcaggggaatggagcccctctgcagccggccgctggtaccttccctattgaacccttctttaggcttgctcactctttttgatgggtgtctttccaaagctggctggggacctccctgattgagagacatggggccagttctgttgctgtggctacacgggaataataaagcagaagaacacctgaggaaagctgatgtttact

SEQ ID NO: 1520 - DNA, 4080 bp, Homo sapiens
  ref <308>: DATABASE ACCESSION NUMBER: NM_014700
  ref <309>: DATABASE ENTRY DATE: 2001-06-18
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatat

SEQ ID NO: 1521 - DNA, 6476 bp, Homo sapiens
  ref <308>: DATABASE ACCESSION NUMBER: NM_014715
  ref <309>: DATABASE ENTRY DATE: 2001-06-18
cactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgatgaatctactgctaaatatagtcatttggaataattttaagtattgatcttaaaacttgtaccacaacaagagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcagttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcatt

SEQ ID NO: 1522 - DNA, 4318 bp, Homo sapiens
  ref <308>: DATABASE ACCESSION NUMBER: NM_014721
  ref <309>: DATABASE ENTRY DATE: 2001-06-18
gcttcccggctgccaggctacagaactcgcctcgccactcctgagacatggacaacgccgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagagaacactgaaaaccactctgaaacaccggcagctcctgctctacctccttctgctcctcctaagcctagatccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagt

SEQ ID NO: 1523 - DNA, 5530 bp, Homo sapiens
  ref <308>: DATABASE ACCESSION NUMBER: NM_014723
  ref <309>: DATABASE ENTRY DATE: 2001-06-18
ggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagggttgttgagaggagtcaatggcataatacgggaagccccgaaccacgggccaactgggaagttgatggtcggcgagaccagcccatcctaatttggggttcctggtcctgctccaggagtcctacagcctgcagcccctaccagagagggaggactgaacagcaagggggtgtgtgggtctgagtatcagggtcctggggaagaagcaggcctggctcgtagagtagaagactcggtgccggcagtcaggaggccctgctcctgaagcctctgtgaccttgggcacggccttcactctgtctggggcacattcactcatctggagaacacagggttggactgattacttttagccactcctgacagttgtggttttaagttgggtggtgggaacctgtgcaccagccctattcaattcactggtggaggcagccgtggtctgccaggccctcgctcctggggtgtcctgccgaagggtgagaagagaagccatgccgggcagcggccccagcgagaggatgacgtggcctggcccggccctttctgcgggccccccaacccgccctctctcctcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattccggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcaccctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgaggaccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctaggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagc

SEQ ID NO: 1524 - DNA, 5426 bp, Homo sapiens
  ref <308>: DATABASE ACCESSION NUMBER: NM_014737
  ref <309>: DATABASE ENTRY DATE: 2001-06-18
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagag

SEQ ID NO: 1525 - DNA, 5022 bp, Homo sapiens
  ref <308>: DATABASE ACCESSION NUMBER: NM_014738
  ref <309>: DATABASE ENTRY DATE: 2001-06-18
cggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgct

SEQ ID NO: 1526 - DNA, 7239 bp, Homo sapiens
  ref <308>: DATABASE ACCESSION NUMBER: NM_014747
  ref <309>: DATABASE ENTRY DATE: 2001-06-18
cggacgcgtgggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccggacccttttatcacatcgcctcctctgggagcctgccctgattgccttcacctcatttcttgaaaattggtgttttggcagaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattggcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctcttcccctggggttccagccctcctaatacctcatattccccatcttcctcagcccagaaagcaatggggctttagtgatgctcctcttttgtgtctctctggttgcctctagcactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattacccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatgg

SEQ ID NO: 1527 - DNA, 2640 bp, Homo sapiens
  ref <308>: DATABASE ACCESSION NUMBER: NM_014750
  ref <309>: DATABASE ENTRY DATE: 2001-06-18
aaatagacactttggtttgaaagatgtaaacattccaaccttggaaggtagaattcttgttgaattagatgagacatctcaagagcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattccttcgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaaccatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttg

SEQ ID NO: 1528 - DNA, 2504 bp, Homo sapiens
  ref <308>: DATABASE ACCESSION NUMBER: NM_014754
  ref <309>: DATABASE ENTRY DATE: 2001-06-18
ctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaagtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagcttggtgccttttacatcgggtttgttctccttccatggtgtgttgctgacattgtcactgagtcccatgtgaggtgctggtgagtattacctttcatctgtgccatgctctagaaccttgaccttgatagttcaccacgtctgatggatccctgttttaaataaaaacgattcactttaaagcct

SEQ ID NO: 1529 - DNA, 5316 bp, Homo sapiens
  ref <308>: DATABASE ACCESSION NUMBER: NM_014767
  ref <309>: DATABASE ENTRY DATE: 2001-06-18
cggacgcgtgggaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccatatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccctgcctccacttggggaccctgcctcgtgtcgtctttatctgcctattactcagcctaaggaaacaagtacactccacacatgcataaaggaaatcaaatgttatttttaagaaaatggaaaataaaaactttataaacacc

SEQ ID NO: 1530 - DNA, 3950 bp, Homo sapiens
  ref <308>: DATABASE ACCESSION NUMBER: NM_014770
  ref <309>: DATABASE ENTRY DATE: 2001-06-18
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtggtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttg

SEQ ID NO: 1531 - DNA, 3020 bp, Homo sapiens
  ref <308>: DATABASE ACCESSION NUMBER: NM_014773
  ref <309>: DATABASE ENTRY DATE: 2001-06-18
cgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctc

SEQ ID NO: 1532 - DNA, 2287 bp, Homo sapiens
  ref <308>: DATABASE ACCESSION NUMBER: NM_014776
  ref <309>: DATABASE ENTRY DATE: 2001-06-18
cgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagttgcttggaaaagatgctaattaatgaagaggagcaactactattggtgtatttttcacagattggtgctttctaaataaaaattgaaagtaactcctaacattgaatgggtttgctactgaaaaagtaatgatcttctggtgcaaacagttgcttgtggacttaaaccttggcactggtggggaatttggtcagattttacaatctctgtcaaagagtagacagctgaactcacaccacacccagcttatagaatgtccatggaagatgaaggcgcaccagaagggaaggaccctgcgcagaatggacgtggtgaatggtgtttaaaatgccagatgccaaagagtaacacgattccctgctgaccccttaactctaatccatccagcaccatggagcagcctgcatgtgaggaatggaaggagcattcagggcctccaagtgacagtctctaaaatggggtggtgccaggcagattagcatgttcaaagctgacaccactgaggtcgtgttttttgggtgacaaagccaaaggagagaaaggccaaatattccagccctggccgaaagatgatcactcaccagacggaagcaagcgtgctgcgtggagcatccatgcgaagatgtcaattccatagatcaataggtttccagttttcttcgtgatatgttaatatagcaaacttaccatgatccggttttctcttttttctctttttttttacaaagtgctgaattgtttggaatatcaagagtattatgtaataaaaacttgttgatcat

SEQ ID NO: 1533 - DNA, 2620 bp, Homo sapiens
  ref <308>: DATABASE ACCESSION NUMBER: NM_014782
  ref <309>: DATABASE ENTRY DATE: 2001-06-18
caactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagtctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactg

SEQ ID NO: 1534 - DNA, 6313 bp, Homo sapiens
  ref <308>: DATABASE ACCESSION NUMBER: NM_014785
  ref <309>: DATABASE ENTRY DATE: 2001-06-18
gccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacctggggaaccaaggataggggaaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcgagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaat

SEQ ID NO: 1535 - DNA, 2470 bp, Homo sapiens
  ref <308>: DATABASE ACCESSION NUMBER: NM_014791
  ref <309>: DATABASE ENTRY DATE: 2001-06-18
ttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 1536 - DNA, 3997 bp, Homo sapiens
  ref <308>: DATABASE ACCESSION NUMBER: NM_014808
  ref <309>: DATABASE ENTRY DATE: 2001-06-18
ggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctcccc

SEQ ID NO: 1537 - DNA, 4932 bp, Homo sapiens
  ref <308>: DATABASE ACCESSION NUMBER: NM_014811
  ref <309>: DATABASE ENTRY DATE: 2001-06-18
gcgcggcccgggcgcggggcggcggcagcggcggcgcgcggggaggcggggaggcggggggcccggccggacgcccctgcgccccctccccgcgccccggccgagggcggagcgcgctggccctgcagcctccggcccgcccccggcccgccgcctcccccgggacgtgggacgcgggcgcaggcggggtccgcgcggcgggcggcgggggacgggcggagtcaaaagtctattgaaaaagcagagagagaatgcctcggtgtgtaagtggagtgatgaggacctgatctctgggccgtgtgggaacactggctgccatttcatcacagtcaacctggactcacagaatttcaagagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcgacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagccggccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttatatggc

SEQ ID NO: 1538 - DNA, 6830 bp, Homo sapiens
  ref <308>: DATABASE ACCESSION NUMBER: NM_014812
  ref <309>: DATABASE ENTRY DATE: 2001-06-18
ccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggggattgataatactgtatttgttttaagcccacagtgtttttactccactttcaaaaagtcaatttgggcactttttttcatttttttttaatgggaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 1539 - DNA, 4933 bp, Homo sapiens
  ref <308>: DATABASE ACCESSION NUMBER: NM_014817
  ref <309>: DATABASE ENTRY DATE: 2001-06-18
cagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctggccgagcccgtgtgcccggagcgctgcgactgccagcatccccagcatctcctgtgcaccaacagggggctccgcgtagtgcccaagaccagctcgctgccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacagcctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgctctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagttaatagttgcagtatttcttttaaatgtttttgttttaaacttaggggtaggatcctttatttgttcagttgtttccaactatttgggatactttcattccctgctatttatgaagtacatgtttatcactaagtgtagtggtttggtttacattaataattttatgtgtggtctaaaaatgcagtcactaagagaatgtacactgtggttatggtcacagtggttatggatttattggcagtggagtaccatggaggtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagat

SEQ ID NO: 1540 - DNA, 5217 bp, Homo sapiens
  ref <308>: DATABASE ACCESSION NUMBER: NM_014838
  ref <309>: DATABASE ENTRY DATE: 2001-06-18
gccgcgggaggggcgcgggggcagacaaagccgcggtaatgaatggagcgtccgcccgcgccgccgtcgtccgcagccggccgggagccgccccagaggccgggccgaggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagccatatttctagaaacatcctgaaagatggaattatgacgaaaaagtgaagataatctacattcgggggcacaaatgagcacttggatcagtgttttatgaacctaagatacagccggagtagttatggtcagtcatggagaataacttgaaaacttgtcccaaagaggacggtgatttcgtttctgataaaataaagtttaaaatagaagaggaagatgatgatggaattcctcctgatagtttggaaagaatggactttaaaagcgagcaggaggacatgaagcagacagacagcggtggggagcgagcgggcctcggtgggacgggttgcagctgcaagcccccggggaagtacttgtctgcagagagtgaggatgactatggcgcgctgttctcccagtacagcagcaccctatacgacgtggccatggaggccgtgacccaaagcctcctttccagccggaacatgagctccaggaagaagtctccagcctggaagcatttttttatctctccccgagacagcactaaagcaatatgcatgtactgtgtgaaggagttcagcagaggcaaaaacgagaaagacttgagtaccagttgtctcatgaggcacgtgaggcgcgcacacccgaccgtgctcattcaggaaaatggcagcgtgtctgccgtgtcctcgttcccctctccctcactcctgcttccaccgcagcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccggtaaagccggtcagagagtccccttcggcctcctcctcccctgacaggctgactgaggacttgcagtctcacttgaaccctggagatgggctgatggaagacgtggcggccttctcatcttccgatgacgtaggggaggcctcggcgtcctctcctgagaagcagcaggctgatgggctgagtcctagattgtttgaatctggtgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaagccaattaaatattctgagtgagactaatcactcatttgcctacgaccttttagaaaagttgttttgttgaaatactgtacatacgcttaatctaaatttgcattgactatgttttagtgtatttataaatggtgaactcagtttctgaaattaaacttcttatttgcaatttt

SEQ ID NO: 1541 - DNA, 6828 bp, Homo sapiens
  ref <308>: DATABASE ACCESSION NUMBER: NM_014840
  ref <309>: DATABASE ENTRY DATE: 2001-06-18
aatctcccaaggcctaaggaggcaagaggcctgcaaatcgcctcctgctcagcaaacgggttgctcagcaggcccggggtcctggtccaccccaggtccctggtttgcccacctccgatggcggccttcgctggcagggtgggcgcctctggggagccagctccgtcccggcgcctttagagccccatctcttccacgtccctggccttcctccccttccaggcggctgtccccgccggggtccagatggtgtcggagggccggcggttcgacggcgggcccggggttcagcctcccggcctccctccgtccctgactctcctttcttcggagagggcgcgggggccggggccaaagcgccgctcttggggttctcctggactcggagttgccccaggcgggcgcagctctgccccgcggggtgccagcctcgggcgggcaaggtccgtgagtcaccgcctgtaaccgaacaccaggcctccctgccccctcccccagctccggccgccaggctgcggcgacacctacaagaaaatgaaggggcgcccaggcccgcggcggccccggccgtatcgcgagcaggtcccggcggcccccggctcgcggcgctctttcttccccggccccggggctcggccagccgcaaccgccgccccggcgccagcaggaatccaggccgagcgaccggccccggagcccgaggcggcggagggcccgcggtagctgcgactggcgagcccgagagcgcccggggagggggcgcccggcttggaatttcccggtcccttccggcccagcgaggacaaagcactcctggccgccgccgccgccgccgccgtggcctacgccgcgccgcacaaagggcgagtcgcgacacgctcccatccccctcccagctcacggcggccccggccccgggtggctgcagggaggtgggggaagccctggctgcaccgcccctcgctccccctcccctggggccgcgcgagcgccgcccccgccccgtctgcgcgtcctcccggggaggggttggggggcgcggcgccccacataacactccccctcctgcgctgcgagccaccctctcccctccctcctgcaaacaccaccgcctcccctgccaccgccgccacctcgcccgacgctccacagctcgccgcggccggggggcggtgcgcggaccgtgcgcgccgcgggcgccagatgtgcagtccccgccgccgccagtgaccgagccgcagtccgagcggtatcgggccgcctccctgatgctgcgggggcgaccttgagcgtacagcggcttccctcggtggggaccccgacatcccagcgctgtgcccggtcttgccctctgtagcccggctcgccccgcgcttggacatggaaggggccgccgcgcctgtggcgggggaccgccccgacttggggctgggggcgccgggctctccccgagaggcggtggcgggggcgactgcagccctggagcccaggaagccgcacggggtgaagcggcatcaccacaagcacaacttgaagcaccgctacgagctgcaggagaccctgggcaaaggcacctacggcaaagtcaagcgggccaccgagaggttttctggccgagtggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatacggtggatgctgatggtgaaccccgatcgccgggccactattgaggacattgccaaccactggtgggtgaactggggctataagagcagcgtgtgtgactgtgatgccctccatgactctgagtccccactcctggctcggatcattgactggcaccaccgttccacagggctgcaggctgacaccgaagccaaaatgaagggcctggccaaacccacgacctctgaggtcatgctagagcggcagcggtcgctgaagaaatccaagaaagagaatgactttgctcagtctggtcaggatgcagtgcctgaaagcccatccaagttgagttctaagaggcccaaggggatcctgaagaagcgaagcaacagcgagcatcgctctcacagcactggcttcattgaaggtgtagttggtcctgccttaccctctactttcaagatggagcaggacttgtgcaggactggcgtgctcctcccaagctcaccagaggcagaggtgccgggaaaactcagccccaagcagtcggccacgatgcccaagaaaggcatcttgaaaaagacccagcagagagaatcaggttactactcttccccagagcgcagtgagtcttcggagctgttggacagtaatgatgtgatgggcagcagcatcccctcccccagccccccggacccagccagggtaacctcccacagcctctcctgccggaggaagggcatcttgaaacacagcagcaaatactcagcgggcaccatggacccagccctggtcagccctgaaatgcccacactggaatccctgtcagagcctggtgtccctgccgagggcctctcccggagctacagccgcccttccagtgtcatcagcgatgacagcgtgctgtccagcgactcttttgacttgctggatttgcaggagaatcgccctgcccgccagcgcatccgcagctgcgtctctgcagaaaacttcctccagatccaggactttgaggggctccagaaccggccccggccccagtacctgaagcggtaccggaaccggctggcagacagcagcttctccctcctcacagacatggatgatgtgactcaggtctacaagcaagcgctggagatctgcagcaagctcaactagcattccagggcgcccaggggcgggcgggggtacgagggaggaaggggagcaagacttgggctcacaggctggttacctctttgctggctgtgacaacagactgaaaaaggattggcactgtctcacttggccaagtttgcagccttgagccaacacctaaaagggagaggtgggctcttctgccagttctgtcaattgtcagtcagaatttgggccctgtttggcatttgctttatggcacctcctagaggaccagctgtccaggggaggtggtattgaccggcactcagtgggtggagaggaagcatatgtggaaggagcatttccttagaaatgcttcattcatccagatgcttctggaggaggggcaggagacacttgggctgtttgccttgggcgagcccaaagaacttgccccttttctccttgcattagcaagctaggtctggctgcgtggagctggcaagtagatttcagcaacttgagcttgagttgatgatcaattaatagtggctgccagttgtgctggcgtaagtggcccacatcatggggaaggagtgctgtgattgactagtaatggctaccacgggaaagggaaggggaagcagtagcactaatgctatgtagttgtcatctttgatctggctaggccctgggaatcgggtttagtcatcctgtgggatctgtgttaactctttcatgccactggtgaggcatttgttaatttgctactcaactttgaggaaagacagggccttggtcagagagagaatgctctgaactctgctaaggacatagagtcagcccatggtgatttagctccttgctgttcacctcctctttcctgatgtctgccttgctctacagcacaacctcttgagggtggacagggagaaagatgatggtgtcagaggtcaaaactattatatatgacagggcacaagatggtctgtgatctttgcacagatgaatggaagttgatgcacaccaacaagaggcaacttgtcactttctttctcaatattaactggaatgctgcctcttgggttctcacctgcatggatgctttgagttggatgtgatactgtccatattctccagaggattacctggctgaaccattggctctgttcaccagtgacagatggtttccccatccactgagtgtagcatcctcagaggtaggcaagtttgcttctagggagttagcatgtagatgggatattgggatgaggaaaggaaaatcaggtagatggtgctttttttcccccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagtaaacaaaacaaaacaaaacaaaacaaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgagaaaaaaattcaccttacagtgctaagaaagtgcattagaatggaattgccctttccttaaggagacagtttgggctctccccttgccaccggctctggtgttttggcttatgcgttccttcaggttgagctgagcagtgtgttatgggaagctgctcaatttcctttcattcaattccacctccttcctgaactctaatagaggttaaaagggaaaaaaaaaattctgtagatagcaaattgtgtgtgtgggggggggtgggggtgtgggtgcatggaggacaacctgcaactctgagctccctacttcctgcctcatttcatgcagtcttttctgaacagcctatgctgctgccctgctggccccttgtgcacggcagctggccgtgtccgtagctgtcagtatgacttagatctagctcctacctactggttgatgtgttttttccttttgccaagtgattgagtctgtttagtagtttccatcattctagtctttaagtaaaaatgacactattgaggaaagtcagtctactcccttcttcctccccccaaacacgtgttctcttttgtcaggaaactcagccagtgggctgtggcagagaaagtcctccactcagaggcagagactgagttaagtcataggtggccttaggcatctgcattgtttgcaggggttaagttttccttccagtgagggctggagggatgaattagctggtacctgaagccccgcttagctctgacactctgccaacatcctctgattctaggtgtggtgttgactgtcctttcaaggaaaaacttgcaatagagggaaaagccattaaagcagctccctgcttcatcattaagtcctgtcatccctaccagccaatcccagtcaaagaagttatgctttattcacttctgtggaattacaagtgagagacacttttaggacctgatggacaaagcaggagattcactgtcagctttcctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgcttcttcagatgatggggagcacttttcagggtgaaattcaggcgagttttgcccaggcctgctgtcttgagtacaaatgtgaatgatcgactgactgcttgttgccaaactggaaatgttctgtagggatttactggcatggtatcattcctagaagaaaaaaagagagaaacttgactgcacattaaaaaaaaaaaaatccacattgtgacttttatttaatttctattttttttggtaataaaaagttgacttttttatttgaatttgtcttttttatttattggtctgaaaggcatttcaaaggtattataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggtttttgtttctgtttttatttttaaattaaataaattgcaatgaactg

SEQ ID NO: 1542 - DNA, 6415 bp, Homo sapiens
  ref <308>: DATABASE ACCESSION NUMBER: NM_014862
  ref <309>: DATABASE ENTRY DATE: 2001-06-18
caggccttgtcatctctcacctggactgctgtgaccttcattcattcccaggagaagtccagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcaaacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccagtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcatcgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagcccttgttctgccagctggagccaagaagcacagagacacagaggcacctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggatgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccattcccctgttttcagggacctctgccttctcccacaccccttacactagtgaggactccttcggcctcttgtgttttcttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacgtgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattgtacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagcacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 1543 - DNA, 5547 bp, Homo sapiens
  ref <308>: DATABASE ACCESSION NUMBER: NM_014865
  ref <309>: DATABASE ENTRY DATE: 2001-06-18
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatattaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatcctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatccctaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttt

SEQ ID NO: 1544 - DNA, 6149 bp, Homo sapiens
  ref <308>: DATABASE ACCESSION NUMBER: NM_014870
  ref <309>: DATABASE ENTRY DATE: 2001-06-18
cccaaatctattaaagcagcaccctgataccacttactctgttgcattgttatgaagacttaaggtaacagagctaaacaccagtgcactgcctgtaacagagtgagcacacaataacttacagctcttactgtttacagtgataaccagctacttaatacctggctcatgtttccatgtgccacttgtttcttggtaacaaacaagagtcatggaaatcatgggatgtacagtcagaatggtttcccttgtcctagaatttggataaacctaatgaaatataaaagcaagttgagtttccctagttctgggtggcagggtcctatttaagagagagaagggaatggggaagataagcccagcattactttccaccggctccatccaggagtaaggccaggtgactttggggatgccagttggtgggtagagagcagcgtggctgtgtgcagtgggtaccagcgtggcctggcaccctgggcttcatgctgtgcttcctctggaggcctgggctgagacagtgctcttggtatcctgtgctagattcctaacactgattagtagcatctcttctggcctctggtgtgcttggcttccctaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacatggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccattataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttg

SEQ ID NO: 1545 - DNA, 6586 bp, Homo sapiens
  ref <308>: DATABASE ACCESSION NUMBER: NM_014875
  ref <309>: DATABASE ENTRY DATE: 2001-06-18
ctggggagccggcgctggaggtggtgagtggcgtggggactgtgtcgagggggtccccaaggtgccggaccctgcggaggggcgaagtttcggcactggggagggcgtgcggacgctttccctacaggcgaccactgctctgcgggcgggtggtcttagctccagtcccccattcagttcctcagcattccaggtcggcggcgaaggggtccccgaacgaagggcgcaaggcagcgtctctgctgggaccgggaagccggacttcagggcctctcggcccgtgggcttctccccgagtctccccgagtcggttggcattaagagtttagcagatactttcagaaatggatacataagaaatggctggaaatcaaatgaatgtccaaagaagagcttagggtcttagtaacattcttttttaaaataactgtctgccaaaatgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgatgatgggatttagtgaagaaccaggaataattccaagattttgtgaagatcttttttctcaagtagccagaaaacaaacccaagaggtcagctatcacattgaaatgagcttctttgaagtatataatgaaaaaattcacgaccttctggtttgtaaagatgaaaatgggcagagaaagcaaccactgagagtgagggaacatcctgtttatggaccatatgttgaagcactgtcaatgaacattgtcagttcttacgctgatatccagagttggctagaattgggaaataaacaaagagctactgctgctactggtatgaatgataaaagttcccgatctcattcagttttcaccctggtgatgacccagaccaagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggagacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggtgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataagtaaataaataaataaataaaatatcttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattatggaaatagtttgacgtttttgacctcaagagtatgtataatttgaagagatactttgtaactatgcttgggtgatattgagcagttcctaaagaataattcattt

SEQ ID NO: 1546 - DNA, 2112 bp, Homo sapiens
  ref <308>: DATABASE ACCESSION NUMBER: NM_014878
  ref <309>: DATABASE ENTRY DATE: 2001-06-18
ggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacactggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggt

SEQ ID NO: 1547 - DNA, 1024 bp, Homo sapiens
  ref <308>: DATABASE ACCESSION NUMBER: NM_014886
  ref <309>: DATABASE ENTRY DATE: 2001-06-18
ggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggaaaaaaaaaaaaaaaaaaaaaa

SEQ ID NO: 1548 - DNA, 3432 bp, Homo sapiens
  Modified_base 1 ... 3432: n = a,c,g, or t
  ref <308>: DATABASE ACCESSION NUMBER: NM_014889
  ref <309>: DATABASE ENTRY DATE: 2001-06-18
ctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcaaaaatatccgtgcagaaaccctttcttcaaaatgttgaaccggtccctctccacgttcatgaacgccttcacagctagtgattatactctgtatccattttccacacaaaatcccaaggactttcagaatctcctctcggtgtatttggatgccaccttttccccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagaattttctcctgatgttggatataatggctacacgagggaggcctactttagtgtcggcctccaagggattgtggagaaagacattgagaccgtcagaagcctcatagacagaacgattgatgaagtagttgagacaaggattgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcatcctcaccaagctgggctgcggccttcttgactaccgggagcaggctcagcagatagaattgaagaccggagggatgagtgcttctccccacgtgctccccgacgactcacacatggacacctacgagcaggtaggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggangcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccaagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctgattctagaatatttaagaatctaaaaataaagggcaactctgactta

SEQ ID NO: 1549 - DNA, 4606 bp, Homo sapiens
  ref <308>: DATABASE ACCESSION NUMBER: NM_014905
  ref <309>: DATABASE ENTRY DATE: 2001-06-18
cgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgcgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctacgccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgcttgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaaaaaaaaaaa

SEQ ID NO: 1550 - DNA, 5047 bp, Homo sapiens
  ref <308>: DATABASE ACCESSION NUMBER: NM_014935
  ref <309>: DATABASE ENTRY DATE: 2001-06-18
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccatcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgaaggagaagcggaggagcctgcagctcccggccagcccggcccccgaccccagtccccggccagcctacaaagtggtgcgccgccaccgcagcatccacgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctgctgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgcgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacacattcctcctcagctccacccacctggagacgaatgtagccagagaggaggaaggagggaaactgaaaacaccgtggcccctcggccttctctctgctagagttgccgctcagaggcttcagcctgacttccagcggtcccaagaacacctactaattcctctccactccttcatggctgggacagttactggttcatatgcaagtaaagatgacaatttactcaac

SEQ ID NO: 1551 - DNA, 4256 bp, Homo sapiens
  ref <308>: DATABASE ACCESSION NUMBER: NM_014945
  ref <309>: DATABASE ENTRY DATE: 2001-06-18
cgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtctaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatactcccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccct

SEQ ID NO: 1552 - DNA, 5109 bp, Homo sapiens
  ref <308>: DATABASE ACCESSION NUMBER: NM_014965
  ref <309>: DATABASE ENTRY DATE: 2001-06-18
aacaagatgagctgatagggttcccaggctgcctggagttacataacccattgtgcttccaggacagctcacaatcttaggatttgccctaacaagcaaactcagaaaactgctgaggaaggcacgggagggtggctgtgcgaggtactgccggggctgagctctcatggaggctctctctgttctctgaagtgcctttggagtttatgtctgcacatggcattggtttttcaattcgggcagcccgtcagggctcagcctctgccaggactctgccacggcaagctcattcggacaaacgcctgtgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcctggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgatcgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccacaaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatgg

SEQ ID NO: 1553 - DNA, 4839 bp, Homo sapiens
  ref <308>: DATABASE ACCESSION NUMBER: NM_014967
  ref <309>: DATABASE ENTRY DATE: 2001-06-18
gtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccgactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggtcgattctatcaagaacaatggcaaactgaacagaggcagtcaggaggccaaatgtctgattctttgttctgtacctttcagtagtctgcaaattttctaccaaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccacattagcagtgttactcttggaactgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaact

SEQ ID NO: 1554 - DNA, 2579 bp, Homo sapiens
  ref <308>: DATABASE ACCESSION NUMBER: NM_014968
  ref <309>: DATABASE ENTRY DATE: 2001-06-18
tgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcagtaagtgatctctcaacaattttgtttttgttttataatagacattttgtcttgttactagcttaactggcattttgatatttttatgtgaaatagattactttaaatgggtaagggtttataactagtaatctgttggttatttcctaaacattatttcagcctgtgctttttattttattggaacaaaacagggctaaagtaagtttttttgtttctccatccaaagaattacatgacttttgttataaacaatcatctgtggtatatttaaatacagaaactaggattttagtatcaagtctgggctgttggtggaggttgtactgtggtaccagctgcattgtggatgtggaaatcttccttccagtacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctg

SEQ ID NO: 1555 - DNA, 7444 bp, Homo sapiens
  ref <308>: DATABASE ACCESSION NUMBER: NM_015032
  ref <309>: DATABASE ENTRY DATE: 2001-06-18
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacaattcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacatttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgttttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 1556 - DNA, 4220 bp, Homo sapiens
  ref <308>: DATABASE ACCESSION NUMBER: NM_015239
  ref <309>: DATABASE ENTRY DATE: 2001-06-18
acgttgcccgggatgcggacaggttccgccgcctccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacggagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgagggaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttggaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtgcagggtttgccttgaaaccattacattctacatttaccaaattaaacaaataaaaactgtattaaatgttgc

SEQ ID NO: 1557 - DNA, 3689 bp, Homo sapiens
  ref <308>: DATABASE ACCESSION NUMBER: NM_015383
  ref <309>: DATABASE ENTRY DATE: 2001-06-18
aagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtagaacactgagcaggacaactgacctgtctccttcacatagtccatatcaccacaaatcacacaacaaaaaggagaagagatattttcggttgaaaaaaagtaaaaagata

SEQ ID NO: 1558 - DNA, 1371 bp, Homo sapiens; identical to SEQ ID NO: 191
  ref <308>: DATABASE ACCESSION NUMBER: NM_015392
  ref <309>: DATABASE ENTRY DATE: 2001-06-18

SEQ ID NO: 1559 - DNA, 1637 bp, Homo sapiens
  ref <308>: DATABASE ACCESSION NUMBER: NM_015416
  ref <309>: DATABASE ENTRY DATE: 2001-06-18
tgattgcctatctcttcttgaccccaagaccttccttggatttcagaagtgtcaagccttgggatacaatctccgagactcctgctttacattagggactcaaggcgtgagggagcttctaggactgattcccagatagtctctttgatcttccttgtaggtcttcaaagcttcacctttctccaaaggcagatgtgaagaacttgatgtcttatgtggtaaccaagacaaaagcgattaatgggaaataccatcgtttcttgggtcgtcatttcccccgcttctatatcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaaaaaaaaaaaaaaaa

SEQ ID NO: 1560 - DNA, 1781 bp, Homo sapiens
  ref <308>: DATABASE ACCESSION NUMBER: NM_015417
  ref <309>: DATABASE ENTRY DATE: 2001-06-18
gggccgctcccagctgggacgtgagtctctggattaggcaggcagaggcagttatgggcttctgcagtggcgagaaaggaagcgcctgaagggtcgtgaggctggggcgggacccggcaccgctggggcggccaggccgtgaggacttcaatggcgagcagcgtggacgaggaggcgctgcaccagctgtacctgtgggtagacaacatccctctgtcccggcccaagcgaaacctctcccgggactttagcgatggagtccttgttgcagaggtcatcaagttttacttccccaagatggtggagatgcacaattatgtccccgccaactctctccagcagaagctcagcaactggggtcatctgaacaggaaggtactgaagaggctgaacttttcagtaccggatgacgtgatgcgcaagatcgcgcagtgcgccccaggcgtggtggagctggtgctcatcccgctgaggcagcgcctggaggagaggcagaggcgcaggaagcagggcgccggctccttacaggagctggctccccaggatggcagtggctacatggatgtgggtaaggtggccttttccatttctccctcccggttggagctttccttctgtccttcttcctgtcacttgtaagagtggaagtagggagggggaagcaggagaatgagactccagcacagtcattcctccacttgccttgtctcaggtgtatcccagaaggcccgaggtgaaggtgtcccggacccccagggagggggtcagctcagctgggaccggccgccggcgcctcggcctccagcgtataaccgggcgttgcagggcgaccccagcttcgtcctccagatcgctgaaaaggagcaggagctgttggcctctcaagagaccgtgcaggtcctgcagatgaaggtaaggcgcctggagcacctgctccagctcaagaatgtgcggatcgaagacctctcccggcggctccagcaggcggagcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtgggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatccacgctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttctaaaaaaaaaaaaaaaaaaaaaaaaaaaaaaaaaaaaaaaaaaaaaaaaaaaaaaaaaaaaaaaaaaaaa

SEQ ID NO: 1561 - DNA, 1338 bp, Homo sapiens
  ref <308>: DATABASE ACCESSION NUMBER: NM_015420
  ref <309>: DATABASE ENTRY DATE: 2001-06-18
atgaaggtgaagatgctgagccggaatccggacaattatgtccgcgaaaccaagttggacttacagagagttccaagaaactatgatcctgctttacatccttttgaggtcccacgagaatatgtaagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataa

SEQ ID NO: 1562 - DNA, 3463 bp, Homo sapiens
  ref <308>: DATABASE ACCESSION NUMBER: NM_015434
  ref <309>: DATABASE ENTRY DATE: 2001-06-18
agcgcgcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgg

SEQ ID NO: 1563 - DNA, 2283 bp, Homo sapiens
  ref <308>: DATABASE ACCESSION NUMBER: NM_015474
  ref <309>: DATABASE ENTRY DATE: 2001-06-18
cccacgcgtccgcccacgcgtccgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggggtaagttccttgggggagaggaagaagctgcttagttatatccagcgattggttcaaatccacgttgatacaatgaaggtaattaatgatcctatccatggccacattgagctccatcctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttgggatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcaggtgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactggaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacgcctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgccttaattttgtattttgaatgtacacgcatgctgaagctaagtaacttttaatcaaagaaataagatggtattaggcaaatcttactatactatgaaaagcattaccttgcctatttttaatattattaaagcctttctccttcgaaaaaaaaaa

SEQ ID NO: 1564 - DNA, 1943 bp, Homo sapiens
  ref <308>: DATABASE ACCESSION NUMBER: NM_015493
  ref <309>: DATABASE ENTRY DATE: 2001-06-18
ggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagctctgtgcctgtgtgtccagccctggagccagccagtgcatttattttaagctcttagaagcaactccttggcccaggaatgcgtgacccctgagatgggtccacgcatctctctacacgtccttctctccgtgggatactggactcgtgcctctgcgcccattctcttctcacgcatatccatgagctttaatttcactttctgatcacggtacgtccataaagccagtattacacttaaatgaagtattcttttttgtaatcgtttttttttagaaggtaaaaaaatttaataaagctaccaataatgttgaaaaaaaaaa

SEQ ID NO: 1565 - DNA, 2398 bp, Homo sapiens
  ref <308>: DATABASE ACCESSION NUMBER: NM_015507
  ref <309>: DATABASE ENTRY DATE: 2001-06-18
ccgcagaggagcctcggccaggctagccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcaaaaaaaaaaaaaaaaa

SEQ ID NO: 1566 - DNA, 2331 bp, Homo sapiens
  ref <308>: DATABASE ACCESSION NUMBER: NM_015513
  ref <309>: DATABASE ENTRY DATE: 2001-06-18
tggcagcgacgcggtgaggagacggcccacggcgcccgcgggctggggcggtcgcttcttccttctccgtggcctacgagggtctggatccttccctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcagggggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctgcaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatctagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaaaaaaaaaa

SEQ ID NO: 1567 - DNA, 1619 bp, Homo sapiens
  ref <308>: DATABASE ACCESSION NUMBER: NM_015515
  ref <309>: DATABASE ENTRY DATE: 2001-06-18
agttctgcggtgccagggagtggagcagagctcagccccgtcccaaacacagatgggaccatgaactccggacacagcttcagccagaccccctcggcctccttccatggcgccggaggtggctggggccggcccaggagcttccccagggctcccaccgtccatggcggtgcggggggagcccgcatctccctgtccttcaccacgcggagctgcccaccccctggagggtcttggggttctggaagaagcagccccctactaggcggaaatgggaaggccaccatgcagaatctcaacgaccgcctggcctcctacctggagaaggttcgcgccctggaggaggccaacatgaagctggaaagccgcatcctgaaatggcaccagcagagagatcctggcagtaagaaagattattcccagtatgaggaaaacatcacacacctgcaggagcagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaaggaccttagacaacctgaccattgtcacaacagacctagaacaggaggtggaaggaatgaggaaagagctcattctcatgaaggagcaccatgagcaggaaatggaggagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcaggcacagtacagcacgaaatctgctttggaaaacatgttatccgagacccagtctcggtactcctgcaagctccaggacatgcaagagatcatctcccactatgaggaggaactgacgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaagtctattttcccccaaggaaagtccttgcacagacaccagtgagtgagttctaaaagatacccttggaattatcagactcagaaacttttatttttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagc

SEQ ID NO: 1568 - DNA, 1113 bp, Homo sapiens
  ref <308>: DATABASE ACCESSION NUMBER: NM_015523
  ref <309>: DATABASE ENTRY DATE: 2001-06-18
ggggcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaggtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaaaaaaaaaaaaa

SEQ ID NO: 1569 - DNA, 2381 bp, Homo sapiens
  ref <308>: DATABASE ACCESSION NUMBER: NM_015524
  ref <309>: DATABASE ENTRY DATE: 2001-06-18
ttttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaaaaaaaaaaaaaaaaaaaaaaagaaaaaaaaaaaaaaaaa

SEQ ID NO: 1570 - DNA, 1560 bp, Homo sapiens
  ref <308>: DATABASE ACCESSION NUMBER: NM_015544
  ref <309>: DATABASE ENTRY DATE: 2001-06-18
ggcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtcctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactccgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcgtttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctaaaaaaaaaaaaaaaaaaaa

SEQ ID NO: 1571 - DNA, 2013 bp, Homo sapiens
  ref <308>: DATABASE ACCESSION NUMBER: NM_015599
  ref <309>: DATABASE ENTRY DATE: 2001-06-18
ctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaaaaaaaaaaaaaaaaaaaaa

SEQ ID NO: 1572 - DNA, 3306 bp, Homo sapiens
  ref <308>: DATABASE ACCESSION NUMBER: NM_015623
  ref <309>: DATABASE ENTRY DATE: 2001-06-18
tggcctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatatagttatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctactgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgctctagtggccctcttcctgtaaacccagatggcgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccagagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtactcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatctcagagctgccccttccccagcagcaaacactcgctgagtccacgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacattatgtctataaatgggtgcactttactgtttgaatttgtaactgaagtactggatatttaagtgtgagtaatgtcttcattagaaaatagcagaaccgctcttgtcttttagtgtatttttcaagaaagaaaaggagaaggaagaggaagaagaaggagaaagaagaagaagaagaagaactaagaagaactaagaagaaggagaagaagagggagagaagaaagaagaaaaggagaaggaagaagaagaactaagaagaaggaggaagaaagaaggagaaggaagaagagagaaggagaaggaagaaggagaggagaagaaggaagaaggagaaggaagaggaggaagaactaaagaaggagaaggaagaggaagaaggaaaaaaaaaaaaaaaa

SEQ ID NO: 1573 - DNA, 2201 bp, Homo sapiens
  ref <308>: DATABASE ACCESSION NUMBER: NM_015640
  ref <309>: DATABASE ENTRY DATE: 2001-06-18
gggggtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggacttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcattttgggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactaatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataaaaaaaaaaaaaaaaaa

SEQ ID NO: 1574 - DNA, 2714 bp, Homo sapiens
  ref <308>: DATABASE ACCESSION NUMBER: NM_015641
  ref <309>: DATABASE ENTRY DATE: 2001-06-18
gagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaagggcgctacgtttattgcctcgtcttattcactgacctttgtaatgatacacagtgaattctttttgacaaagagaaatgcagtgtagtatgcagagctgctgttttaatgccctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatgttttcatggctaggtatttctaatgtttattcttccctgtgtacttctacacatagctatgcactatgaaaattaaatggaatgaatgatatgtatattactcaaaataaagtttctttcactttaaaaaaaaaaaaaaaaaaaa

SEQ ID NO: 1575 - DNA, 3809 bp, Homo sapiens
  ref <308>: DATABASE ACCESSION NUMBER: NM_015678
  ref <309>: DATABASE ENTRY DATE: 2001-06-18
attcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttagagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggagattccagaagcttatttcattagagacccccacactttccttcttacaaaggactttattaaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaaaaaaaaaaaaaaaaaaaa

SEQ ID NO: 1576 - DNA, 3472 bp, Homo sapiens
  ref <308>: DATABASE ACCESSION NUMBER: NM_015721
  ref <309>: DATABASE ENTRY DATE: 2001-06-18
tggcggccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacatctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctggcccagattctcactgccttccctgcccttaggtttgtggaagtgcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgctttagcaaatactggccgcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagcgcttcttaaagtccattgctgagggcattggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcaaaaaaaaaaaaaaaaaaaaaaaaa

SEQ ID NO: 1577 - DNA, 2452 bp, Homo sapiens
  Modified_base 1 ... 2452: n = a,c,g, or t
  ref <308>: DATABASE ACCESSION NUMBER: NM_015881
  ref <309>: DATABASE ENTRY DATE: 2001-06-18
ctcttctctctttttttctttattagtcttgctagcggtctatcaattttgttgatcctttcaaaaaaccagatcctggattcattaattttttgacgggatttttgtgtctctatttccttcagttctgctctgattttagttatttcttgccttctgctagcttttgaatgtgtttgctcttgcttttctagttcttttaattgtgatgttagggtgtcagttttggatctnncctgcttctcttgtgggcattagtgctatagttcctctanncgcttgaatgtgtccagagattctgggnatgttgtgtctttgttctcgttggtttcggaaattccctatcacaagtagaccaacacagacacgaaggttggaaataataccatccatgtncaccgagaaattcacaagataaccaacaaccagactggacaaatggtcttttcagagacagtatcacatctgtgggagagcaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtnccagtggcctcctctgccagccccacagccacagcctggtgtatgtgtgcaagccgaccttcgtggggagccgtgaccaagatggggagatcctgctgcccagagaggtncccgatgagtataagttggcagcttcatggaggaggtgcgccaggagctggaggacctggagaggagcctgactgaagagatggcgctgggggagcctgcggctgccgccgtgcactgctgnnnggaagagatttagatctggaccaggctgtgggtagatgtgcaatagaaatagctaatttatttccccaggtgtgtgctttaggcgtggnctgaccaggcttcttcctacatcttcttcccagtaagtttcccctctggcttgacagcatgaggtgttgtgcatttgttcagcncccccaggctgtnctccaggcttcacagtctggtgcttgggagagtcaggcagggttaaactgcaggagcagtttgccacccctgtccagattattggctgctttgcctctaccagttggcagacagccgtttgttctacatggctttgataattgttgaggnnaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctcagcacagcctggngagggngtcattgttctcctcgtccatcagggatctcagaggctcagagactcgaagctgcttgcccaagtcacacagctagtgaagaccagacgagtttcatctggttgtgactctaagctcagtgctctctcactaggggaacagccttggtnccaccaaaagtgcnnnccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtcctctttggcagttgcattagtaactttgaaaggtatatgactgagcgtacgatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacagatgatgttttcaggtgtcatggactgttgccaccatgtattcatccagagttcttaaggtttaaagttgcacatgattgtataagcatgctttctttgagttttaaattatgtataaacataagttgcatttagaaatcaagcataaatcac

SEQ ID NO: 1578 - DNA, 4382 bp, Homo sapiens
  ref <308>: DATABASE ACCESSION NUMBER: NM_015892
  ref <309>: DATABASE ENTRY DATE: 2001-06-18
gttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcagaagtgcatatgttttcagtcatccccaacaaattccttccaaacagtaagagcccctgttggtacgaggagttctcggggcagaacaccaccgacccctacctcaccaactcctacgtgctctactccaaagcgcttccgctccaccttcgacgccctgcgcaaggccttctggggcacctggcggcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccaatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctggggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcacggtatggaaaaccccaggactctgccactctaggcacacatgaattataaccattttggaatttccttcgtgatgttcgagagctcagcaatggacccctcacagagctcctctaatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcatttcagtacatattttactatccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaaaaaaaaaaaa

SEQ ID NO: 1579 - DNA, 961 bp, Homo sapiens
  ref <308>: DATABASE ACCESSION NUMBER: NM_015895
  ref <309>: DATABASE ENTRY DATE: 2001-06-18
tcttctgtgcttcaccatctacataatgaatcccagtatgaagcagaaacaagaagaaatcaaagagaatataaagaatagttctgtcccaagaagaactctgaagatgattcagccttctgcatctggwtctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaa

SEQ ID NO: 1580 - DNA, 2147 bp, Homo sapiens
  ref <308>: DATABASE ACCESSION NUMBER: NM_015907
  ref <309>: DATABASE ENTRY DATE: 2001-06-18
ggctcttttaaatgaccccaggcgtcgtgtattgaatcctagactcacgtccgtctcgccggcgcccgagccagtccgcgcgcaccgcgtctgcgtccccgaaagccccgcccgcaagggctgccctgcctacctggtctccgacgtgctcgtctggagggcggtgcgaggggccgagccgacgagatgttcttgctgcctcttccggctgcggggcgagtagtcgtccgacgtctggccgtagtacgttctgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagttaaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgaaaaaaaaaaaaaaaaaaaaaaa

SEQ ID NO: 1581 - DNA, 1880 bp, Homo sapiens
  ref <308>: DATABASE ACCESSION NUMBER: NM_015925
  ref <309>: DATABASE ENTRY DATE: 2001-06-18
atgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcaca

SEQ ID NO: 1582 - DNA, 2157 bp, Homo sapiens
  ref <308>: DATABASE ACCESSION NUMBER: NM_015937
  ref <309>: DATABASE ENTRY DATE: 2001-06-18
gcggctatgccgtctggctctgctcgtcctgttgctcctggggcccggcggctggtgccttgcagaacccccacgcgacacctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgcaacacaaaaa

SEQ ID NO: 1583 - DNA, 1561 bp, Homo sapiens
  ref <308>: DATABASE ACCESSION NUMBER: NM_015954
  ref <309>: DATABASE ENTRY DATE: 2001-06-18
ggcccgctccaacatcagaatggtaacagctttcaggagcctaccacgcggcagctccggagctgccgcgtccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaa

SEQ ID NO: 1584 - DNA, 1553 bp, Homo sapiens
  ref <308>: DATABASE ACCESSION NUMBER: NM_015955
  ref <309>: DATABASE ENTRY DATE: 2001-06-18
tgccgcctcctcctgggctgggcgcggtgtctcgtcccctcgcggagcgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaaaaaaaa

SEQ ID NO: 1585 - DNA, 1341 bp, Homo sapiens
  ref <308>: DATABASE ACCESSION NUMBER: NM_015961
  ref <309>: DATABASE ENTRY DATE: 2001-06-18
aggtgtttgggtttcttcgcggctgctcaagatgaaccgactcttcgggaaagcgaaacccaaggctccgcgccccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgccaacagtcattcaacatggacaggccattataccatccagtctttgaaggacaccaagaccacggttgatgctatgaaactgggagtaaaggaaatgaagaaggcatacaagccagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagg

SEQ ID NO: 1586 - DNA, 979 bp, Homo sapiens
  ref <308>: DATABASE ACCESSION NUMBER: NM_015964
  ref <309>: DATABASE ENTRY DATE: 2001-06-18
ctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattccagggcaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagcccaggcatggctaacccctgactgcttgcctcatatttaagctgctgctctggccaagtgcctaattttaacccagacctcaataaagacaccttttgtaccaaaa

SEQ ID NO: 1587 - DNA, 1728 bp, Homo sapiens
  ref <308>: DATABASE ACCESSION NUMBER: NM_015984
  ref <309>: DATABASE ENTRY DATE: 2001-06-18
cgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaacgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtccaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttaaaaaaaaaaaaaaaaaaaaaaaaaa

SEQ ID NO: 1588 - DNA, 3320 bp, Homo sapiens
  ref <308>: DATABASE ACCESSION NUMBER: NM_015986
  ref <309>: DATABASE ENTRY DATE: 2001-06-18
ctagatgactgccagaagctcatagaacacggagtcaacactgcagaggacttagtccgagaaggtgaaatcgccatgcttggtggtgtgggagaagagaatgggaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggagctggagcctgagctgctgttgcaggaggcccgcgagaacgtggaggcagcgcagagctaccggcgggagctgggtcaccggcttgaggggctgcgtgaggcgcggaggcagatcaaagaaagtgcatcacagacaagggatgttctcaaacagcattttaatgatttaaagggaaccgttggaaagctcctggatgagcgattggtgacccttttgcaagaggtggacaccattgaacaggagaccattaaaccactagatgactgccagaagctcatagaacacggagtcaacactgcagaggacttagtccgagaaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgcgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataattttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggtgtcggccaccacacctggctaatttttgtatttttagtagagacagggtttcaccatgttggccaggctggtctttaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcgtatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattctattttaatgtgaattatttttttcatttttaccagtagtaaaaaagtagaaaagcaagtatgatatttttgtaagataatttatttggggattcatgttcccctgttagacaatcatgaccttttctacttgtctttttatatataagtagtagatttccacttgtttagggattaagaagatgttctagaatgtagataccttgtccagccataggaatcaaaataaaaaactaaaaaaaaaaaaaaaaaaaaaaaaaaaaaa

SEQ ID NO: 1589 - DNA, 1079 bp, Homo sapiens
  ref <308>: DATABASE ACCESSION NUMBER: NM_015987
  ref <309>: DATABASE ENTRY DATE: 2001-06-18
ggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaagggggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggaccagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaa

SEQ ID NO: 1590 - DNA, 967 bp, Homo sapiens
  ref <308>: DATABASE ACCESSION NUMBER: NM_015991
  ref <309>: DATABASE ENTRY DATE: 2001-06-18
ggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaaaaaaaaaaaaaaaaaa

SEQ ID NO: 1591 - DNA, 1379 bp, Homo sapiens
  ref <308>: DATABASE ACCESSION NUMBER: NM_016000
  ref <309>: DATABASE ENTRY DATE: 2001-06-18
gcggcaacagcggggccgatgtgtagttggtgactgcctctccagatgctgaggtgcctgtatcattggcacaggccagtgctgaaccgtagtggagtaggctgtgccttctgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcgaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcttaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcattt

SEQ ID NO: 1592 - DNA, 2127 bp, Homo sapiens
  ref <308>: DATABASE ACCESSION NUMBER: NM_016002
  ref <309>: DATABASE ENTRY DATE: 2001-06-18
atggcgacggagcagaggcctttccacctggtggtgttcggcgcgtctggcttcaccggccagttcgtgaccgaggaggtggcccgggagcaggtggacccggagcggacccagcctgccctgggcgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctgtttttgcctagtttttcgccaatctacactgattttggactgttacctaagttgaaaaataaaaggttgtcaatcgaatggtggttaatgttggacctgccgatgtatttgtatagtggtagaaacatgctgcttaagtggcctaacctgtttcttgccaataagtaggcttatcattttatttttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattga

SEQ ID NO: 1593 - DNA, 1763 bp, Homo sapiens
  ref <308>: DATABASE ACCESSION NUMBER: NM_016018
  ref <309>: DATABASE ENTRY DATE: 2001-06-18
aagcaattaacaaagaaggaacatttacagttcagttttatgatggagtaattcagttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtgactggaatagctgattaaaacataaatgctgcttttaggttaaccacaaaggaacaactcaggatcagtcgtgattgctaaagtattcacttttatcttttaggtaagagaaaagaaaaagataaggaaagaagagagaagagagacaaagatcactacagaccaaaacagaagaagaagaggcacctctggtactgaagattcctgctgattttgagaactggatggagaatactttcccatcaggggctggagagggagaagaaacctttttctacagaatcatcaggcatgggtaaggtggctaacgctgagatctctt

SEQ ID NO: 1594 - DNA, 1832 bp, Homo sapiens
  ref <308>: DATABASE ACCESSION NUMBER: NM_016028
  ref <309>: DATABASE ENTRY DATE: 2001-06-18
gaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtcccccaaggaactctgtggaaatgatgacctagcaaccagtttggttcttgatccctatttaggttttcaaacacaccaaatgaatactagcgcctttccttcgaggagctcgaggcatttttccaaatctgacagtttttctcacaacaaacctgtgagatttaggcctattaaaggaaggcagggagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcggatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggccagatctgatgggaaa

SEQ ID NO: 1595 - DNA, 1282 bp, Homo sapiens
  ref <308>: DATABASE ACCESSION NUMBER: NM_016029
  ref <309>: DATABASE ENTRY DATE: 2001-06-18
ctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaa

SEQ ID NO: 1596 - DNA, 808 bp, Homo sapiens
  ref <308>: DATABASE ACCESSION NUMBER: NM_016047
  ref <309>: DATABASE ENTRY DATE: 2001-06-18
tctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacaaaaaaaaaaagtcgacgcggccggcaatttagtagtagtag

SEQ ID NO: 1597 - DNA, 2056 bp, Homo sapiens
  ref <308>: DATABASE ACCESSION NUMBER: NM_016048
  ref <309>: DATABASE ENTRY DATE: 2001-06-18
tcgcagacagctcgggggaacagtggcggcttcggccggcggtccttgcgctccccaacagcggcgcgggcgggtgagccgtcggggcacagtcccggtgctcttctgtttctcagtcttcgcgcgaccctcgtgcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggtttcgcggtgagcgagcgctgcaaggtgcgcctcgtgccgctgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgcacgcctcacgtctcgctcgaacggggatcatagtgaccacgagtgaggctgttctgcgttcagctggtagctgataaggacgcatcgcaaaattcaaggaaattcagaatctaattaaggacgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttgttagagggttttgaaatgtttttcaaatatgtgaaatgtgaaactgctgtcttttatattaaagtaattaaagaaaatgtattgtgattgaaattattttggcctccacaagatggctctatgagtattcttccagggattctaatatttatttaaggtaataaaatcttgacatttataatctttc

SEQ ID NO: 1598 - DNA, 839 bp, Homo sapiens
  ref <308>: DATABASE ACCESSION NUMBER: NM_016050
  ref <309>: DATABASE ENTRY DATE: 2001-06-18
ctctggccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcctgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccaaaaaaaaaa

SEQ ID NO: 1599 - DNA, 1325 bp, Homo sapiens
  ref <308>: DATABASE ACCESSION NUMBER: NM_016056
  ref <309>: DATABASE ENTRY DATE: 2001-06-18
atgtggtcgagtgtaggctcccacgttggaccgggaccggtaggggtagctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaa

SEQ ID NO: 1600 - DNA, 703 bp, Homo sapiens
  ref <308>: DATABASE ACCESSION NUMBER: NM_016058
  ref <309>: DATABASE ENTRY DATE: 2001-06-18
aagacggggattggccatcgcttccggaagttgtgagctttgtttcggagcgggacctccccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttcctttcctgactataaa

SEQ ID NO: 1601 - DNA, 644 bp, Homo sapiens
  ref <308>: DATABASE ACCESSION NUMBER: NM_016066
  ref <309>: DATABASE ENTRY DATE: 2001-06-18
gcgccgcgcgctggcggggaccggcatggtttggagcaggagcggctcggcaggctggcttgacagggcggcgggactgcgggactgcggcactgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctcttcttaaa

SEQ ID NO: 1602 - DNA, 1076 bp, Homo sapiens
  ref <308>: DATABASE ACCESSION NUMBER: NM_016072
  ref <309>: DATABASE ENTRY DATE: 2001-06-18
cgcctggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaagatatttccagttgcactgtatctctggaagtgatgcatgaattcgattggattgtgtcattttaaagtattaaaaccaaggaaaccccaattttgatgtatggattacttttttttgtaaacatggttaaaataaaacttctgtggttcttctgaatctt

SEQ ID NO: 1603 - DNA, 1830 bp, Homo sapiens
  ref <308>: DATABASE ACCESSION NUMBER: NM_016073
  ref <309>: DATABASE ENTRY DATE: 2001-06-18
gcgaccgctcgtccgcccggcttgaggcccgcggggagcgcgccgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattggtccttcagttttgaggccatgtgtaaagtttaaccatattgtaaaatatctattccgtattagaaatagctagttgacagcttatacttctcaacattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtga

SEQ ID NO: 1604 - DNA, 3757 bp, Homo sapiens
  ref <308>: DATABASE ACCESSION NUMBER: NM_016081
  ref <309>: DATABASE ENTRY DATE: 2001-06-18
gcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactctccttgattcaggaatacaaagtctccagctgtgaacagagactcatcagtgaaatagagtacaggctagaaaggtctcctatggatgaatcatggtgatgaacgttcacgtacggcagacgctgcctcgtggaaaactggaatggcaccattctttgagatgaagctgaaacattacaagatctttgagggaatgccagtaactttcacatgtagagttgctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataaaaaaaaaaaaaaaaaa

SEQ ID NO: 1605 - DNA, 1398 bp, Homo sapiens
  ref <308>: DATABASE ACCESSION NUMBER: NM_016108
  ref <309>: DATABASE ENTRY DATE: 2001-06-18
cccagccggtccaggcctctggcgaacatggcgcttgtcccctgccaggtgctgcggatggcaatcctgctgtcctactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaattgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaaaaaaaaaaaaaaaaaaaaaaaaaaaa

SEQ ID NO: 1606 - DNA, 1860 bp, Homo sapiens
  ref <308>: DATABASE ACCESSION NUMBER: NM_016109
  ref <309>: DATABASE ENTRY DATE: 2001-06-18
gcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggtgcgcgaacaccggagcgcacccgcagtcagctgagcgcgctggagcgcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacaaaaaaaaaaaaaaaaaagcggagctcacagagttcttggaataaaagcaacctcagaacaaaaaa

SEQ ID NO: 1607 - DNA, 4422 bp, Homo sapiens
  ref <308>: DATABASE ACCESSION NUMBER: NM_016121
  ref <309>: DATABASE ENTRY DATE: 2001-06-18
gattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattaagctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaaaaaaaaaaaacctcgtgccgaattcggcacgaggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtggtacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcggttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaattta

SEQ ID NO: 1608 - DNA, 598 bp, Homo sapiens
  ref <308>: DATABASE ACCESSION NUMBER: NM_016126
  ref <309>: DATABASE ENTRY DATE: 2001-06-18
gagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaacacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaaaaaaaaaaaaaaaaaaa

SEQ ID NO: 1609 - DNA, 1840 bp, Homo sapiens
  ref <308>: DATABASE ACCESSION NUMBER: NM_016127
  ref <309>: DATABASE ENTRY DATE: 2001-06-18
atcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcagctgggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggaaaaaaaaaaaaaa

SEQ ID NO: 1610 - DNA, 1551 bp, Homo sapiens
  ref <308>: DATABASE ACCESSION NUMBER: NM_016135
  ref <309>: DATABASE ENTRY DATE: 2001-06-18
gcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctg

SEQ ID NO: 1611 - DNA, 999 bp, Homo sapiens
  ref <308>: DATABASE ACCESSION NUMBER: NM_016140
  ref <309>: DATABASE ENTRY DATE: 2001-06-18
ccgctccctgcctggtctcccgcgtccatcggtccattcctgcgtcgttctgtccttccgaacgcacacttcaggagcagccgcgagaagccgggtggcatggcagcgagcacggacatagctgggccgaaggagagcttccggaagtttgccatccatggcgaccccaaggccagcgggcaagagatgaatggcaagaactgggccaagctgtgcaaggactgtaaggtggccgacggaaagtccgtaacacccctgtggacatcgtcttctccaaagtcaaggggaagtctgctcgggtcatcaactatgaggagttcaagaaaggccctggaagagctgcgaccaagagattcggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 1612 - DNA, 2393 bp, Homo sapiens
  ref <308>: DATABASE ACCESSION NUMBER: NM_016142
  ref <309>: DATABASE ENTRY DATE: 2001-06-18
ggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagagtgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcatgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcctataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacacaaaaaaaaaaaa

SEQ ID NO: 1613 - DNA, 2083 bp, Homo sapiens
  ref <308>: DATABASE ACCESSION NUMBER: NM_016153
  ref <309>: DATABASE ENTRY DATE: 2001-06-18
cacgaggcttgcggcaccgcccacccacaccccgtctgccccttgaccccaccacacgccgacgccatgcagtccagtggggagtcggaggcagcctccttcctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcccaaaaaaaaaaaaaaaaaaaaaaaa

SEQ ID NO: 1614 - DNA, 306 bp, Homo sapiens
  ref <308>: DATABASE ACCESSION NUMBER: NM_016171
  ref <309>: DATABASE ENTRY DATE: 2001-06-18
atgtcagacgcagccgtagacaccagctccgaaatcaccaccgaggacttaaaggagaagaaggaagttgtggaagaggcggaaaatggaagagacgcccctgctgacgaggaaaatggggagcaagaggctgacaatgaagtagatgaagaacaggaagaaggtggggaggaagaaggtgatggtgaggaagaggatggagatgaagatgagggagctgagtcagctacggacaagcgggcagctgaagatgatgaggataacgatgtcgataccaagaagcagaagaccgacgaggatgactag

SEQ ID NO: 1615 - DNA, 830 bp, Homo sapiens
  ref <308>: DATABASE ACCESSION NUMBER: NM_016175
  ref <309>: DATABASE ENTRY DATE: 2001-06-18
aaaggactcccaagaactggagctggaaggaacaggagtgtgtttcagcaaacagccttcatccaaaatggaggagccaggcccccgcttcagtcaagacctgcctagaaaaaggaagtggagcgggagcaccgtccagcctccgtgcagccgtggcgtgcaggactcgggtggctctgaggtcgcctggggaccccagaagggacaggctggcctgacatggaaggtgaaacaagcagcagcccctgccttcaggagaactctgcagactgcagtgccggggagctgaggggtcctgggaaggagctatggagtcccatccagcaggttacagccacatcctctaaatgggcgcgatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatcaaaaaaaaaaaaaaaaaaaa

SEQ ID NO: 1616 - DNA, 1271 bp, Homo sapiens
  ref <308>: DATABASE ACCESSION NUMBER: NM_016184
  ref <309>: DATABASE ENTRY DATE: 2001-06-18
ttctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctatacattgactgattcactttttcataaagtgagcatttattgagcattttttcatgtgccagagcctgtactggaggcccccattgtgcacacagggagagaacatgagtctctcttaatttttatctggttgctaaagaattatttaccattaaattatatggtgtggtgt

SEQ ID NO: 1617 - DNA, 704 bp, Homo sapiens
  ref <308>: DATABASE ACCESSION NUMBER: NM_016185
  ref <309>: DATABASE ENTRY DATE: 2001-06-18
tgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgagaactgcacaacttgagcctgactgtacatcttcttggatttgtttcattaaaaagaagcactttatgtaaaaaaaaaaaaaaaaaa

SEQ ID NO: 1618 - DNA, 2180 bp, Homo sapiens
  Modified_base 1 ... 2180: n = a,c,g, or t
  ref <308>: DATABASE ACCESSION NUMBER: NM_016187
  ref <309>: DATABASE ENTRY DATE: 2001-06-18
gagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgagagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctgactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatntatagacacagacacttgcctatacagagacataaccacacacactcagaggatagtgaacaaatctgtctttgacttacgacccattttgcaagacttaaagccgaaagaacacattttcagattgttaaataaagtctgattctgactaaaaaaaaaaaaaa

SEQ ID NO: 1619 - DNA, 489 bp, Homo sapiens
  ref <308>: DATABASE ACCESSION NUMBER: NM_016199
  ref <309>: DATABASE ENTRY DATE: 2001-06-18
cgcgacaagatggcggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcatttctcctttttgtataggttgaatttttgttttcttaataaaattgcaaacctcaaaaaaaaaa

SEQ ID NO: 1620 - DNA, 2366 bp, Homo sapiens
  ref <308>: DATABASE ACCESSION NUMBER: NM_016210
  ref <309>: DATABASE ENTRY DATE: 2001-06-18
ggaggtcacaagctctggtgccccaaaatggctctggtcctcagatatagttggttgccaccctgggagtgagaggaaccaggaaagcagcacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttt

SEQ ID NO: 1621 - DNA, 5634 bp, Homo sapiens
  ref <308>: DATABASE ACCESSION NUMBER: NM_016217
  ref <309>: DATABASE ENTRY DATE: 2001-06-18
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacgaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaataagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtttaaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgcgcctggccaagtttcagttctatatgaagtatttgatgttttgtttgaaacaatacagcattaaagaaccaatgttattcactaatatcattcatctttcagtttggatgatttggtttgctgcatctaggtcggtgtttgatcatctgaaaaaacatttcagtgggaagaaatgcataaaatgcctataagaagtagaaagtcattgaactgacagtgtttgatgcaactaaaagaggattgtaagcatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaaaaaaaaaaaaaaaaaaaaaaa

SEQ ID NO: 1622 - DNA, 1907 bp, Homo sapiens
  ref <308>: DATABASE ACCESSION NUMBER: NM_016223
  ref <309>: DATABASE ENTRY DATE: 2001-06-18
gaattcggcacgagctcgtgccgaatcggcacgagcgcgggcccaggagcggcaggactcgggccggagcgtggccggacccccacccgccgaggggcccagggaggacgcggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggtccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaaaaaaaaaaaaaaa

SEQ ID NO: 1623 - DNA, 2231 bp, Homo sapiens
  ref <308>: DATABASE ACCESSION NUMBER: NM_016228
  ref <309>: DATABASE ENTRY DATE: 2001-06-18
ctttcaaatattttttattgaaatgacaataaaataaaaaaagaacagtgatcactttaaccaaacttactttacaaatataaaaaatataaccaaaacttgggaattccaggccacggcgcggggcgggagggggcgcggcgaggcccgccggcggggcaaaaccggcctgggccctggcggccgcaggagcgcgtgcggcgtggactttgccgggctcgccacacagccccagacccgtttaggaccgggagaccgaacgcagcgtccagccggggagtttcggcggcgttctccgggcaccgcgcgcgggaagccagacgcagcggggggacacatctcgcggtggcgttgccagagtgaggagttagcaggcaggacttgacgaggctctttggtttttctagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtgcgtcacacctataatcccagcactttgggaggcagaggagggaggatcacttgaacccaggaattcaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaaaaaaaaaaaa

SEQ ID NO: 1624 - DNA, 1264 bp, Homo sapiens
  ref <308>: DATABASE ACCESSION NUMBER: NM_016229
  ref <309>: DATABASE ENTRY DATE: 2001-06-18
ttgagactcgagtgaccaggtggaggagaggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgccattgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgaggcccaaggggacgcttgttttaccatgggccacggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcgacctgtggtacaccctggacaggcctcccattggctggaagtacagctcaggcttcgttactgccgacatgatcaaggagcaccttcctcctccagcgaagtccacgctcatcctggtgtgtggcccgccaacactgatccagacggcggctcaccctaacctggagaagctgggttatacccaggacatgattttcacctactaacaaacacctccatgtgctcagcaaatttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggcaagagctccatttcagtatctttctccgtggttttgtgaaataaactcaagtacaaagcaaaaaaaaaaa

SEQ ID NO: 1625 - DNA, 2870 bp, Homo sapiens
  ref <308>: DATABASE ACCESSION NUMBER: NM_016235
  ref <309>: DATABASE ENTRY DATE: 2001-06-18
aggtcgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctaatgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaaaaaaaaaaaaaaaaaaaaa

SEQ ID NO: 1626 - DNA, 3636 bp, Homo sapiens
  ref <308>: DATABASE ACCESSION NUMBER: NM_016240
  ref <309>: DATABASE ENTRY DATE: 2001-06-18
tgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtgcccccggccctccaggaccaagaggattcaaaggagatatgggcgtgaaagggcctgttggcggcagaggcccgaaaggagaccccggcatcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacatacatatgcacgcacacacacatgcacacatacacgtgcacacatacacaggcacacatgcatgcacacatacacatgcacacacacatgcacacatatatgcacaggcacacacatgtatgcacacacacatgcaccgcacacatatccatgcacacaaacacatatatacacatgcacatacacagatttttctgctggccaggtgggccaactgggtttcccctggctgggcaggaggagagggcagaggaagaccccctctcctgtgactgagcctgccagggaggcagctacctcgggaggaaggtctcacatctgtctttgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcagacccgggagctgtcccctgtctgtcacagcacagtggggccacgaggctgacattctctggccttgcacacagtgccccctgagaagttcaacatttatttcttcacgtgtccaggaaaattcctcaattcatccttgcctctgcccttcaggagcagcctggaaggaatccaagcaggagtttcatctgcatgggggcactttgcaggccctggaacattgggcctgagtggagatgggagacagaggcaggccagaaggttctctctgcacagctgcctcccttgctctccctgagggtggcctgccccattccccaagggggctcctttggagtggtagggaggatcaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagatttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagaactatttccaggagt

SEQ ID NO: 1627 - DNA, 1603 bp, Homo sapiens
  ref <308>: DATABASE ACCESSION NUMBER: NM_016243
  ref <309>: DATABASE ENTRY DATE: 2001-06-18
ggtggtccaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcaacctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttgggcatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagaggcccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataatactggctgaggcccctgtgtgatattgaaaaaaaa

SEQ ID NO: 1628 - DNA, 2024 bp, Homo sapiens; identical to SEQ ID NO: 175
  ref <308>: DATABASE ACCESSION NUMBER: NM_016250
  ref <309>: DATABASE ENTRY DATE: 2001-06-18

SEQ ID NO: 1629 - DNA, 1125 bp, Homo sapiens
  ref <308>: DATABASE ACCESSION NUMBER: NM_016267
  ref <309>: DATABASE ENTRY DATE: 2001-06-18
cggcacgaggacagaatcaggtgatggtccagaattaagagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggaaaaaaaaaaaaaaaaaaaaaaa

SEQ ID NO: 1630 - DNA, 2497 bp, Homo sapiens
  ref <308>: DATABASE ACCESSION NUMBER: NM_016271
  ref <309>: DATABASE ENTRY DATE: 2001-06-18
acgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcgttccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacgtcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacatttttttttaacttgatttaataaaaatgttaattttggaagtgcaaaaaa

SEQ ID NO: 1631 - DNA, 1740 bp, Homo sapiens
  ref <308>: DATABASE ACCESSION NUMBER: NM_016299
  ref <309>: DATABASE ENTRY DATE: 2001-06-18
ggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgcccttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcctgactcattatatgaagggcaagattttgattgcaatgtgtccagagcaagatttgaacttctttgttctccactttttaataagtgtttagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaaaaaaaaaaaaaaa

SEQ ID NO: 1632 - DNA, 1159 bp, Homo sapiens
  ref <308>: DATABASE ACCESSION NUMBER: NM_016306
  ref <309>: DATABASE ENTRY DATE: 2001-06-18
gaacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaagg

SEQ ID NO: 1633 - DNA, 1110 bp, Homo sapiens
  ref <308>: DATABASE ACCESSION NUMBER: NM_016307
  ref <309>: DATABASE ENTRY DATE: 2001-06-18
ccgccggcccccccggggccgctcgcgggcatggacagcgcggccgccgccttcgccctggacaagccggcgctgggcccggggccgccgccgcctccacccgcgctggggcccggcgactgcgcccaggcgcgcaagaacttctcggtgagccacctcctggacctggaagaggtggcggcggccgggcggctggcggcgcgccccggggccagggccgaggcgcgggagggcgcagcacgggagccgtccgggggcagcagcggcagcgaggcggcgccgcaggatggtgagtgtcccagcccggggcgcggtagcgccgccaagcggaagaagaagcagcggcggaaccgcaccacgttcaacagcagccaactgcaggcgctggagcgcgtgttcgagcgcacgcactaccccgacgcctttgtgcgcgaggagcttgcccggcgcgtcaacctcagcgaggcgcgcgttcaggtctggtttcagaaccgccgcgccaagttccgcaggaatgaaagggccatgctggccagccgctctgcctcgctgctcaagtcctacagccaggaggccgccatcgagcagcccgtggctccccggcccaccgccctgagtccagattatctctcctggacagcctcgtccccctacagcacagtgccaccctacagccctgggagctcaggccccgcaaccccaggggtcaacatggccaacagcatcgccagcctccgtctcaaggccaaggagttcagcctgcaccacagccaggtgcctacggtgaactgaagtccagtcccaccaggacccagacgcctccctgggtggacagcaatagaaaagggggcagacgcccaggaagtgaccttctcctggatgagctctcctggcccgtctgtccagcctggactcccgagcccacgaggctgttgaggcccctgcagccgggcccagctcttctgtccttggccaccagagactgcagcccacaacccttggaggggttgggccggaaggtggaagagcctgccaaggacctcatttagtttgtgtattaaaaccaaaaagcttttgtctttaagaaataaaaccatttttttaagcccc

SEQ ID NO: 1634 - DNA, 2836 bp, Homo sapiens
  ref <308>: DATABASE ACCESSION NUMBER: NM_016308
  ref <309>: DATABASE ENTRY DATE: 2001-06-18
ctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttctttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacctgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgtccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaaaaaaaaaaaaaaaaaaaaaaa

SEQ ID NO: 1635 - DNA, 1952 bp, Homo sapiens
  ref <308>: DATABASE ACCESSION NUMBER: NM_016321
  ref <309>: DATABASE ENTRY DATE: 2001-06-18
agcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactctcctggggcccagaggagctggtgctgacctagctagggatgcaagagtgagcaagcagcacccccacctgctggcttggcctcaaggtgcctccacccctgccctccccttcatcccagggggtctgcctgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaaaaaaaaaaaaaaaaa

SEQ ID NO: 1636 - DNA, 1833 bp, Homo sapiens
  ref <308>: DATABASE ACCESSION NUMBER: NM_016337
  ref <309>: DATABASE ENTRY DATE: 2001-06-18
ggcacgagtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaaaaaaaaaaaaaaaaaa

SEQ ID NO: 1637 - DNA, 2795 bp, Homo sapiens; identical to SEQ ID NO: 143
  ref <308>: DATABASE ACCESSION NUMBER: NM_016352
  ref <309>: DATABASE ENTRY DATE: 2001-06-18

SEQ ID NO: 1638 - DNA, 2268 bp, Homo sapiens
  Modified_base 1 ... 2268: n = a,c,g, or t
  ref <308>: DATABASE ACCESSION NUMBER: NM_016359
  ref <309>: DATABASE ENTRY DATE: 2001-06-18
gggatttgaaccncgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaatatcttgtaaatattcctgtattctcaacttttttccttttgtaaatttttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaaaaaaaa

SEQ ID NO: 1639 - DNA, 937 bp, Homo sapiens
  ref <308>: DATABASE ACCESSION NUMBER: NM_016364
  ref <309>: DATABASE ENTRY DATE: 2001-06-18
aattcggcacgagggctcaggcagagtcctgcccctgcacccactcccccattcccggccccaggccatgccccaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaaaaaaaaaaaaaaaaaaaaa

SEQ ID NO: 1640 - DNA, 2264 bp, Homo sapiens
  ref <308>: DATABASE ACCESSION NUMBER: NM_016373
  ref <309>: DATABASE ENTRY DATE: 2001-06-18
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatcaaaaaaaaaaaaaaaaaaaaaaaa

SEQ ID NO: 1641 - DNA, 850 bp, Homo sapiens
  ref <308>: DATABASE ACCESSION NUMBER: NM_016401
  ref <309>: DATABASE ENTRY DATE: 2001-06-18
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggttttaatgctgggaacaatcccctttcctgagggaatgggaggatctgtctacttttcttatcctgattcaatggatgccagtatggcactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatggaaaaaaaaaaaaa

SEQ ID NO: 1642 - DNA, 1046 bp, Homo sapiens
  Modified_base 1 ... 1114: n = a,c,g, or t
  ref <308>: DATABASE ACCESSION NUMBER: NM_016403
  ref <309>: DATABASE ENTRY DATE: 2001-06-18
gtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaccaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaaaaaaaaaaaaaaaaaaaaaaaaaaaaaa

SEQ ID NO: 1643 - DNA, 883 bp, Homo sapiens
  ref <308>: DATABASE ACCESSION NUMBER: NM_016411
  ref <309>: DATABASE ENTRY DATE: 2001-06-18
cccggaagtacttgttgcctgagcagtgggctgcttaggaagagaaggtcagagttcgcgggggcagaggcattcttgccgctggcccagtcgctatgtagtggaggggcagacaccctcccgcaaattctggaaggtcttagtctcgactagggcagtagcccccaggactcctagtcgccggcttcaggtcactgccggctgaacggagctgccgtcgccatgtttggctgcttggtggcggggagctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttccttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatggtaaaaaaaaaaaaaaaaaaaaaaaaaaaaaaaaaaaaaaaaaa

SEQ ID NO: 1644 - DNA, 3039 bp, Homo sapiens
  ref <308>: DATABASE ACCESSION NUMBER: NM_016423
  ref <309>: DATABASE ENTRY DATE: 2001-06-18
gcaccccgcccctgcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggcccaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttaaggcacagg

SEQ ID NO: 1645 - DNA, 4221 bp, Homo sapiens
  ref <308>: DATABASE ACCESSION NUMBER: NM_016448
  ref <309>: DATABASE ENTRY DATE: 2001-06-18
cgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctt

SEQ ID NO: 1646 - DNA, 444 bp, Homo sapiens
  ref <308>: DATABASE ACCESSION NUMBER: NM_016459
  ref <309>: DATABASE ENTRY DATE: 2001-06-18
atggtcacagggggcccctggcctaccaggctctccaggacatgtttgcactacttggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctga

SEQ ID NO: 1647 - DNA, 597 bp, Homo sapiens
  ref <308>: DATABASE ACCESSION NUMBER: NM_016463
  ref <309>: DATABASE ENTRY DATE: 2001-06-18
atggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctgcctctgccatcagctccggcaagaagaagcggaaacgctgcggcattgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtga

SEQ ID NO: 1648 - DNA, 435 bp, Homo sapiens
  ref <308>: DATABASE ACCESSION NUMBER: NM_016471
  ref <309>: DATABASE ENTRY DATE: 2001-06-18
atgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtga

SEQ ID NO: 1649 - DNA, 918 bp, Homo sapiens
  ref <308>: DATABASE ACCESSION NUMBER: NM_016475
  ref <309>: DATABASE ENTRY DATE: 2001-06-18
atggcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttcaacacatcactgcattatttgaatgcagcatggcagctattatcaccttacttgtggagtgatccagttggtgttctttatattcgttcatgtcgagtattgatgcttcctgactggtacacgatgctttacagcccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactga

SEQ ID NO: 1650 - DNA, 360 bp, Homo sapiens
  ref <308>: DATABASE ACCESSION NUMBER: NM_016477
  ref <309>: DATABASE ENTRY DATE: 2001-06-18
atgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtga

SEQ ID NO: 1651 - DNA, 1059 bp, Homo sapiens
  ref <308>: DATABASE ACCESSION NUMBER: NM_016491
  ref <309>: DATABASE ENTRY DATE: 2001-06-18
atggcattggcgtccgggcccgcaagcgctaagcatggctccgggcagctcggccttgggggcttcggggcccgagacgcggggtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccgctcctctatgggaatgatgccaaggtcttggagcagcccgtggtggtgcagagcgtgggcacggatggacgtgtcttccatttcctag

SEQ ID NO: 1652 - DNA, 882 bp, Homo sapiens
  ref <308>: DATABASE ACCESSION NUMBER: NM_016495
  ref <309>: DATABASE ENTRY DATE: 2001-06-18
atgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctga

SEQ ID NO: 1653 - DNA, 3160 bp, Homo sapiens
  ref <308>: DATABASE ACCESSION NUMBER: NM_016542
  ref <309>: DATABASE ENTRY DATE: 2001-06-18
cagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattacagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgactccgagggctctgattcggaatctaccagcagggaaaacaatactcatcctaaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaagcacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaa

SEQ ID NO: 1654 - DNA, 3042 bp, Homo sapiens
  ref <308>: DATABASE ACCESSION NUMBER: NM_016548
  ref <309>: DATABASE ENTRY DATE: 2001-06-18
cggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttgggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaaaaaaaaaaaaaa

SEQ ID NO: 1655 - DNA, 3179 bp, Homo sapiens
  ref <308>: DATABASE ACCESSION NUMBER: NM_016569
  ref <309>: DATABASE ENTRY DATE: 2001-06-18
ccccccctttttgaaattatgtgctgctgtttaaaacaacaaacaaaaaaaacaacaaaaacacagcaactgcggattttgtccccggctggagcccagcgccccgcctggaatggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagacaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggctcgcagctcggtgcaccgccaccccttccgcaatctgaacaccatgcgcccgcggctgcgctacagcccctactccatcccggtgccggtcccggacggcagcagtctgctcaccaccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgccaccaggcggggaggtgttcaaagacatctcctcagtgcggatttatatatatatttttcttcactgtgtcaaagtggaaacaaaaacaaaatctttcaaaaaaaaaatccggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaaaaaaaaaaaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgct

SEQ ID NO: 1656 - DNA, 1266 bp, Homo sapiens
  ref <308>: DATABASE ACCESSION NUMBER: NM_016577
  ref <309>: DATABASE ENTRY DATE: 2001-06-18
gcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcagccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgc

SEQ ID NO: 1657 - DNA, 2113 bp, Homo sapiens
  ref <308>: DATABASE ACCESSION NUMBER: NM_016582
  ref <309>: DATABASE ENTRY DATE: 2001-06-18
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctccc

SEQ ID NO: 1658 - DNA, 2114 bp, Homo sapiens
  ref <308>: DATABASE ACCESSION NUMBER: NM_016593
  ref <309>: DATABASE ENTRY DATE: 2001-06-18
actgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaaactccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaaggcagcatacttaaaggaatttgatttcatgcataactgtattaaaacattaaatagaaataatgtcatttgaatgaaaatcttatcacattaaattcactgtgaaggcagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgag

SEQ ID NO: 1659 - DNA, 5470 bp, Homo sapiens
  ref <308>: DATABASE ACCESSION NUMBER: NM_016603
  ref <309>: DATABASE ENTRY DATE: 2001-06-18
ccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacattgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacatgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttttataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaaaaaa

SEQ ID NO: 1660 - DNA, 1429 bp, Homo sapiens
  ref <308>: DATABASE ACCESSION NUMBER: NM_016612
  ref <309>: DATABASE ENTRY DATE: 2001-06-18
ccccctcccctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacgggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctgccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaa

SEQ ID NO: 1661 - DNA, 760 bp, Homo sapiens
  ref <308>: DATABASE ACCESSION NUMBER: NM_016619
  ref <309>: DATABASE ENTRY DATE: 2001-06-18
gagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttaactgataaaaaaaaaaaaaaaaaataaaaaa

SEQ ID NO: 1662 - DNA, 2056 bp, Homo sapiens
  ref <308>: DATABASE ACCESSION NUMBER: NM_016620
  ref <309>: DATABASE ENTRY DATE: 2001-06-18
tgtacaaagtgcaatgtgaatttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagaaaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaagcccacttgaaagacttggaaagacgaaatgggatgctcacaaatctccaatctgggtctgaatgagatgatgcaaaatgaggaaaaatatgaaaaaatcttaaaggcattggaa

SEQ ID NO: 1663 - DNA, 1919 bp, Homo sapiens
  ref <308>: DATABASE ACCESSION NUMBER: NM_016623
  ref <309>: DATABASE ENTRY DATE: 2001-06-18
ggggaggcgcgtcgagacagcgtgcctccttttgtgcgagcgccggcgctcggcttctcgaaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagagggcaatccagcatccagcagatgagaagttgcaagagaaggcatggggtgcagttgttccactagtaggcaaatttaaagaaattttacgaattttctcagaggttagaagcagcattaagaggtcttctgggagccttaacaagtaccccatattctcccacccagcatctagagcgagacaggctcttgctaaacagtttgcagaaattcttcatttcacactccggtttgatgaactcaagatgacaaatcctgccatacagaatgatttcagctattatagaagaacattgagtcgtatgaggattacaatgtacccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattcctgcttgagggtaatggtgggtgtcataatactctatgaccacgtacatccagtgggagcatttgctaaaacttccaaaattgatatgaaaggttgtatcaaagttcttaaggaccaaccctcctaatagtgtggaaggtcttctaaatgctctcaggtacacaacaaaacatttgaatgatgagactacctccaagcaaattaaatccatgctgcaataacaattctgggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgatataaataaaaatcagctttcatttttctaaaaaaaaaaaaaaaaa

SEQ ID NO: 1664 - DNA, 731 bp, Homo sapiens
  ref <308>: DATABASE ACCESSION NUMBER: NM_016625
  ref <309>: DATABASE ENTRY DATE: 2001-06-18
gagcttaaactgaagcaagttcggtggacgccggcggcgccctgatctaaagaaacgactcagggactgcggcgcttgcacgtcaacgggaggtgtgagcccaaaggtctggacccagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaagggagaggataaagggaaggacaaggaatacataacatcaaacgtgggaatctggaaacatcaaagctggatttagaacatcttgccaccagctgaacaggccaaagccagactacagctggttcttgaagctgctgcaaaagctgatgaagcattgaaagccaa

SEQ ID NO: 1665 - DNA, 798 bp, Homo sapiens
  ref <308>: DATABASE ACCESSION NUMBER: NM_016629
  ref <309>: DATABASE ENTRY DATE: 2001-06-18
agtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttaaaaaaaaaaaaa

SEQ ID NO: 1666 - DNA, 1482 bp, Homo sapiens
  ref <308>: DATABASE ACCESSION NUMBER: NM_016640
  ref <309>: DATABASE ENTRY DATE: 2001-06-18
gcttaagttgacctctgggtccggaatcgcgggcaaagatggcggcggccaggtgttggaggcctttgctacgcggtccgaggctttcattgcacaccgcggctaatgccgccgccacggctacagaaacgacctcccaagacgtcgcggcgacccccgtcgcgcggtacccgccgattgtggcctccatgacagccgacagcaaagctgcacggctgcggcggatcgagcgctggcaggcgacggtgcacgctgcggagtcggtagacgagaagctgcgaatcctcaccaagatgcagtttatgaagtacatggtttacccgcagaccttcgcactgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaaaaaaaaaaaaaaaaa

SEQ ID NO: 1667 - DNA, 1729 bp, Homo sapiens
  ref <308>: DATABASE ACCESSION NUMBER: NM_016645
  ref <309>: DATABASE ENTRY DATE: 2001-06-18
tcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctccccgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcaaaaaaaaaaaaaaaaaaa

SEQ ID NO: 1668 - DNA, 1076 bp, Homo sapiens
  ref <308>: DATABASE ACCESSION NUMBER: NM_016650
  ref <309>: DATABASE ENTRY DATE: 2001-06-18
ggtttcaatatatgcagatgtctcgatataggaatgaaattacgtctttggaacaacttaaataagtcaaatatacttggagctttaaaaattaaaaggagagagattcgagcaccttttctgctgccatgacaaccatgcaaggaatggaacaggccatgccagggttggcctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgcatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcttaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaacaaaagatcaacagacaaatgctccagaaatctatgctgactgtgacacaagagcctcacatgagaaattaccagtatccaacttcgatactgatagacgtgttgatattattattatatgtaatccaattatgaactgtgtgtgtatagagagataataaattcaaaattatgttctcatttttttccctggaactcaataactcacttcactggctctttatcgagagtactaggagttaaattaataaataatgcatttaatgaggccacaggaaaaa

SEQ ID NO: 1669 - DNA, 929 bp, Homo sapiens
  ref <308>: DATABASE ACCESSION NUMBER: NM_016657
  ref <309>: DATABASE ENTRY DATE: 2001-06-18
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaa

SEQ ID NO: 1670 - DNA, 3806 bp, Homo sapiens
  ref <308>: DATABASE ACCESSION NUMBER: NM_016733
  ref <309>: DATABASE ENTRY DATE: 2001-06-18
ctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggc

SEQ ID NO: 1671 - DNA, 1021 bp, Homo sapiens
  Modified_base 1 ... 1021: n = a,c,g, or t
  ref <308>: DATABASE ACCESSION NUMBER: NM_016815
  ref <309>: DATABASE ENTRY DATE: 2001-06-18
gagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccaccggaggtgggagaaaatctgggcacgatcgggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtcnttgacatttggggggaacagcaggtgccagagctaaaaggtacctttgtctgccattgatccagctcagaacgattggaaataaatttgaaatgtaaccgagcaaaaaa

SEQ ID NO: 1672 - DNA, 2905 bp, Homo sapiens
  ref <308>: DATABASE ACCESSION NUMBER: NM_016817
  ref <309>: DATABASE ENTRY DATE: 2001-06-18
cggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtctgcaggaaccccgaacagttccccctggtgcagggagtggccataggtggctcctatggacggaaaacagtcttaagaggcaactccgatggtacccttgtccttttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggtccaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctcggcatcttctggaaggtcaattacaactttgaagatgagaccgtgaggaagtttctactgagccagttgcagaaaaccaggcctgtgatcttggacccaggcgaacccacaggtgacgtgggtggaggggaccgttggtgttggcatcttctggacaaagaagcaaaggttaggttatcctctccctgcttcaaggatgggactggaaacccaataccaccttggaaagtgccgacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgccttcttggacttcttgaaatcaatcaagactgcaaaccctttcataaagctgccttgctgaactcctctctgcaggagccctgcttaaaatagttgatgtcatcactttatgtgcatcttatttctgtcaacttgtatttttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccaggccaaccctttcattagaacttcaagctctccaaaggctcagattataactgttgtcatatttatatgaggctgttgtcttttccttctgagcctgcctttatccccccacccaggagtatcctcttgccaaagcaaaagactttttccttggctttagccttaaagatacttgaaggtctaggtgctttaacctcacataccctcacttaaacttttatcactgttgcatataccagttgtgatacaataaagaatgtatctgg

SEQ ID NO: 1673 - DNA, 2894 bp, Homo sapiens
  ref <308>: DATABASE ACCESSION NUMBER: NM_016818
  ref <309>: DATABASE ENTRY DATE: 2001-06-18
gaattccggtttcttcctaaaaaatgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaaaccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaacccgagtcacccagctggtctcatacatagacagcacttgtgaaggattgaatgcaggttccaggtggagggaagacgtggacaccatctccactgagccatgcagacatttttaaaagctatacacaaaattgtgagaagacattggccaactctttcaaagtctttctttttccacgtgcttcttattttaagcgaaatatattgtttgtttcttcctaaaaaaaaaaaaaaaaaaaaa

SEQ ID NO: 1674 - DNA, 2574 bp, Homo sapiens
  Modified_base 1 ... 2574: n = a,c,g, or t
  ref <308>: DATABASE ACCESSION NUMBER: NM_016820
  ref <309>: DATABASE ENTRY DATE: 2001-06-18
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttnatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatgg

SEQ ID NO: 1675 - DNA, 1679 bp, Homo sapiens
  ref <308>: DATABASE ACCESSION NUMBER: NM_016839
  ref <309>: DATABASE ENTRY DATE: 2001-06-18
agacttggaaaccccaaagtgtccgcgaccctgcacggcagctcccttccagcttcatgggcaaagtgtggaaacagcagatgtaccctcagtacgccacctactattacccccagtatctgcaagccaagtttggaaggcattcgggaataccaagtgaaaaggaagagtgaagaacagaaaaatgttagtgggatggcaaacactgtgaacattgctgtttctagtgggccagaaaaatcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaa

SEQ ID NO: 1676 - DNA, 1924 bp, Homo sapiens
  ref <308>: DATABASE ACCESSION NUMBER: NM_017414
  ref <309>: DATABASE ENTRY DATE: 2001-06-18
cgcccgggcaggttagaattcagcgaccgcttaattctaggctcagtcccgacgtggaactcagcagcggaggctggacgcttgcatggcgcttgagagattccatcgtgcctggctcacataagcgcttcctggaagtgaagtcgtgctgtcctgaacgcgggccaggcagctgcggcctgggggttttggagtgatcacgaatgagcaaggcgtttgggctcctgaggcaaatctgtcagtccatcctggctgagtcctcgcagtccccggcagatcttgaagaaaagaaggaagaagacagcaacatgaagagagagcagcccagagagcgtcccagggcctgggactaccctcatggcctggttggtttacacaacattggacagacctgctgccttaactccttgattcaggtgttcgtaatgaatgtggacttcaccaggatattgaagaggatcacggtgcccaggggagctgacgagcagaggagaagcgtccctttccagatgcttctgctgctggagaagatgcaggacagccggcagaaagcagtgcggcccctggagctggcctactgcctgcagaagtgcaacgtgcccttgtttgtccaacatgatgctgcccaactgtacctcaaactctggaacctgattaaggaccagatcactgatgtgcacttggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggaggacgccctgcactgcttcttccagcccagggagttatcaagcaaaagcaagtgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggtcttgcttcaatgactccaatatttgcttggtgtcctgggaagacatccagtgtacctacggaaatcctaactaccactggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgaccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgagcatctcttctccataagatagtgtgataaacacggtcatgaataaagttattttccccgaaaaaaaaaaaaaaaaaaaaaaaaaa

SEQ ID NO: 1677 - DNA, 854 bp, Homo sapiens
  ref <308>: DATABASE ACCESSION NUMBER: NM_017422
  ref <309>: DATABASE ENTRY DATE: 2001-06-18
cccggatccctgcggctgcctgcactctggaccacgagctctgagagcagcaggttgagggccggtgggcagcagctcggaggctccgcgaggtgcaggagacgcaggcatggccggtgagctgactcctgaggaggaggcccagtacaaaaaggctttctccgcggttgacacggatggaaacggcaccatcaatgcccaggagctgggcgcggcgctgaaggccacgggcaagaacctctcggaggcccagctaaggaaactcatctccgaggttgacagcgacggcgacggcgaaatcagcttccaggagttcctgacggcggcaaggaaggccagggccggcctggaggacctgcaggtcgccttccgcgccttcgaccaggatggcgacggccacatcaccgtggacgagctcaggcgggccatggcggggctggggcagccgctgccgcaggaggagctggacgccatgatccgcgaggccgacgtggaccaggacgggcgggtgaactacgaggagttcgcgaggatgctcgcccaggagtgaggctccccgcctgtgtccccctggctgcgctctgagccttcagggccaccgcccgctgctgcttttgtgctgggactctccggggaaacctggtcggtggatgggaaactgcctccccctgggaggaaggctttgcgctccggggcctggatgcggcgccctcgggccgcctgcgagcccctctctgccttcagaccttgggcagaaggaggcctccttgggcctggtccccctttgccctgcagtggaatgagggccccttaaccccgcattgatctaaataaaggactgccgagttccaaaa

SEQ ID NO: 1678 - DNA, 4266 bp, Homo sapiens
  ref <308>: DATABASE ACCESSION NUMBER: NM_017423
  ref <309>: DATABASE ENTRY DATE: 2001-06-18
ccgggctgtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcaacgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaagtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaaaacaaaaactgaaccgtatcggtccccagccatggctgggggattatgtgccattgaacgagagttcttctttgaattgggtctctatgatccaagtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgccaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctggaaacctgctgcaactattgttattaactctgtatagctccaaacctggaacctcctgatcagtttgaaggacattgataaactgtgattttacaataacattatcatctgcagttactgtttacaagactgctttttaccttaaactttgtagatgtttacatcttttttgttgtgttttaaagatgatgttggtaatttgtgccttttagctctgttttattaaacagagttaaagcatgttgtcttctttgggattacactcaggggttctgaaaggcagtttgatttttatttttaacacacttgaaaaaaggttggagtaaccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgaccatatggaacatcccaaggctgtcccataagggttggaagttgtgtagcattcactcccttacctactggcattcccagtgccctctgtccatacctacttctaggattgcaaagggagtcttccaactagaagaaaaattgtccactgacatttgggatttacttttctccaatacctgccaatacagaaaactattatcagttgttattgttatcccttgaaaagcgagggtgacaaaaacaacaaaacaccgttataaacacatcaaaggttcattctgactgaggtaagactttccaagcccttgttagattaggccttataaaacttgtgtgcattataacctaagctgtgcaacctggtgaagccaagagtgaactgatgtttcatttatattttcatccaaatgacattatctgcacgtttttaaaatttaaaaacaaaggactatttaaaaatacagtttattaacaaacgtgaaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttgggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactaggcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 1679 - DNA, 1042 bp, Homo sapiens
  ref <308>: DATABASE ACCESSION NUMBER: NM_017447
  ref <309>: DATABASE ENTRY DATE: 2001-06-18
cgcacggaacggcggtggtggcccgcggagcggacaggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgccaaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaataagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactct

SEQ ID NO: 1680 - DNA, 1365 bp, Homo sapiens
  ref <308>: DATABASE ACCESSION NUMBER: NM_017518
  ref <309>: DATABASE ENTRY DATE: 2001-06-18
aagaacgctggaggttgattggcggtcttgccggccagtgaagccagggcatgggcggggcgcggctcggagcgcgaaacatggcggggcaggacgctggctgcggccgtggcggcgacgactactcagaggacgaaggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttct

SEQ ID NO: 1681 - DNA, 2549 bp, Homo sapiens
  ref <308>: DATABASE ACCESSION NUMBER: NM_017522
  ref <309>: DATABASE ENTRY DATE: 2001-06-18
atgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctcactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacttgtggcgacattgatgagtgcaaggacccagatgcctgcagccagatctgtgtcaattacaagggctattttaagtgtgagtgctaccctggctgcgagatggacctactgaccaagaactgcaaggctgctgctggcaagagcccatccctaatcttcaccaaccgcacgagtgcggaggatcgacctgtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcgggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcacgagtggcattaagccttgaagatgatggactaccctgaggatgggatcacccccttcgtgcctcatggaattcagtcccatgcactacactccggatggtgtatgactggatgaatgggtttctatatatgggtctgtgtgagtgtatgtgtgtgtgtgatttttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctggggggcttttttaggttttgggcatttgttttttgtaaataagatgattatgctttgtggctatccatcaacataagt

SEQ ID NO: 1682 - DNA, 3164 bp, Homo sapiens
  ref <308>: DATABASE ACCESSION NUMBER: NM_017540
  ref <309>: DATABASE ENTRY DATE: 2001-06-18
cacatttcttagcttctctgagcctccatttcagcatctgtaaaatgttactacctactttataggttttctgatgaggcttaagtgtggttgtgcatgtgaccatcttagcatagtgtgtggcaatggtaagcactcagtgctgtcagctgtttttaccgctgttattatattactgtgttttcccatgtcattaggtctgtgatccaggcttcagcagacaatccaggctgatgcttttgctgagtgcgctaagggatgctggcctggcgggatggtgaactggaagcagaaacgtcatcctctctcttccttcttgccatgcaggtgtggatgtgtgggggccgcatggaggacatcccctgctccagggtgggccatatctacaggaagtatgtgccctacaaggtcccggccggagtcagcctggcccgggtaagaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaaaaaaaaaaaaaaaa

SEQ ID NO: 1683 - DNA, 3928 bp, Homo sapiens
  ref <308>: DATABASE ACCESSION NUMBER: NM_017555
  ref <309>: DATABASE ENTRY DATE: 2001-06-18
gtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcaaaaaaaaaaaaaaaaaaaaaaaaaaaaaaaaaaa

SEQ ID NO: 1684 - DNA, 1549 bp, Homo sapiens
  ref <308>: DATABASE ACCESSION NUMBER: NM_017572
  ref <309>: DATABASE ENTRY DATE: 2001-06-18
gctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggagttagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcaacacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaa

SEQ ID NO: 1685 - DNA, 2487 bp, Homo sapiens
  ref <308>: DATABASE ACCESSION NUMBER: NM_017585
  ref <309>: DATABASE ENTRY DATE: 2001-06-18
ctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcatggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgt

SEQ ID NO: 1686 - DNA, 2695 bp, Homo sapiens
  ref <308>: DATABASE ACCESSION NUMBER: NM_017586
  ref <309>: DATABASE ENTRY DATE: 2001-06-18
acgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagcgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggcttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttccttcttgtttgttcctctgtgttctgtgtgcgtcttaagcaataaagcgtggccgtggctcgcgaaaaaaaaaaaaaaaaaa

SEQ ID NO: 1687 - DNA, 3674 bp, Homo sapiens
  ref <308>: DATABASE ACCESSION NUMBER: NM_017596
  ref <309>: DATABASE ENTRY DATE: 2001-06-18
cagtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggtacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcctgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaaaaaaaaaaaa

SEQ ID NO: 1688 - DNA, 2133 bp, Homo sapiens
  ref <308>: DATABASE ACCESSION NUMBER: NM_017606
  ref <309>: DATABASE ENTRY DATE: 2001-06-18
agggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgaaaaaaaaaaaaaaa

SEQ ID NO: 1689 - DNA, 1487 bp, Homo sapiens
  ref <308>: DATABASE ACCESSION NUMBER: NM_017617
  ref <309>: DATABASE ENTRY DATE: 2001-06-18
tgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcggggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttgctgtgttttataaaatagagtgtagtttacagaaaaagactttaaaagtgatctacatgaggaactgtagatgatgtatttttttcatcttttttgttaactgatttgcaataaaaatgatactgatggtgaaaaaaaaaaaaaaaaa

SEQ ID NO: 1690 - DNA, 1702 bp, Homo sapiens
  ref <308>: DATABASE ACCESSION NUMBER: NM_017633
  ref <309>: DATABASE ENTRY DATE: 2001-06-18
acaactgctaaagctccagagacacgagcgtgtgtggcagcaagagccgccagttcgggaccaccgcagctggggtggcagcggcgcaggaggggtcgcggggcgggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagtgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaaggcccttcaaaggtacatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaaaaaaaa

SEQ ID NO: 1691 - DNA, 2571 bp, Homo sapiens
  ref <308>: DATABASE ACCESSION NUMBER: NM_017634
  ref <309>: DATABASE ENTRY DATE: 2001-06-18
tacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaatgccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattgcagccaccaaaaaaaatagacgtaaaaataaaggcatttggctggtccaagatgtaattatcaatcagtcagcacctgtgattcttttacttatttttttgtggtttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttgaaaaaaaaaaaaaaaaaaaaa

SEQ ID NO: 1692 - DNA, 1749 bp, Homo sapiens
  ref <308>: DATABASE ACCESSION NUMBER: NM_017646
  ref <309>: DATABASE ENTRY DATE: 2001-06-18
accaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctacggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttaaaaaaaaaaaaaaaaaaaaa

SEQ ID NO: 1693 - DNA, 2450 bp, Homo sapiens
  ref <308>: DATABASE ACCESSION NUMBER: NM_017660
  ref <309>: DATABASE ENTRY DATE: 2001-06-18
tgtgtgcacagtgcaagacggacttcacgtgccgctggcgggaggaggagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagagaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcctaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaggctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagacttttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagcgatttggggaaaaggaaggaatttgatgttttttggggtgggaggggagggtgtgttttttacaccaaaaaaaaaaaaaaaaaa

SEQ ID NO: 1694 - DNA, 1903 bp, Homo sapiens
  ref <308>: DATABASE ACCESSION NUMBER: NM_017680
  ref <309>: DATABASE ENTRY DATE: 2001-06-18
aataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagagctgtactgtaaatggaatgcttgacttagcaaaatttgtgctctttcatttgctgttagaaaaacagaattaacaaagacagtaatgtgaagagtgcattacactattcttattctttagtagcttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaaaaaaaaaaaaaaaaa

SEQ ID NO: 1695 - DNA, 2780 bp, Homo sapiens
  ref <308>: DATABASE ACCESSION NUMBER: NM_017691
  ref <309>: DATABASE ENTRY DATE: 2001-06-18
tttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacaccacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagctcgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaaaaaaaaaaaaaa

SEQ ID NO: 1696 - DNA, 1807 bp, Homo sapiens
  ref <308>: DATABASE ACCESSION NUMBER: NM_017698
  ref <309>: DATABASE ENTRY DATE: 2001-06-18
cttggcagcctgccttacagggtagcccaccttatagggtagccctcatatctgccctatgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaatttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaaaaaaaaaaaaaa

SEQ ID NO: 1697 - DNA, 869 bp, Homo sapiens
  ref <308>: DATABASE ACCESSION NUMBER: NM_017702
  ref <309>: DATABASE ENTRY DATE: 2001-06-18
agatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattacaaaaaaaaaaaaaaaaaa

SEQ ID NO: 1698 - DNA, 2076 bp, Homo sapiens
  ref <308>: DATABASE ACCESSION NUMBER: NM_017709
  ref <309>: DATABASE ENTRY DATE: 2001-06-18
tctctcactcggtgccgctgcctaggggctgtagaggtcgcgccgctcctgctggggcctgcccacgccaaggacctgcctctgtcgcctcctcttctattgcccagtttccccagccagaacatcccctgaagatggcagaggagagcagctgtaccagggattgcatgtccttcagcgtgctcaactgggatcaggttagccggctgcatgaggtcctcactgaagttgtacctatccacggacgaggcaactttccaaccttggagataactctgaaggacatcgtccagaccgtccgcagtcggctggaggaggcaggcatcaaagtgcacgacgtccggctgaatggctccgcagctggccacgttttggtcaaagataatggcttgggctgcaaagacctggacctaatcttccatgtggctcttccaacagaggcagaatttcagctggttagagatgtggttctgtgttcccttctgaacttcctgccagagggtgtgaacaagctcaaaatcagtccagtcactctgaaggaggcatatgtgcagaagctagtgaaggtttgcacggacactgtccgctggagcctgatctccctctccaacaagaacgggaagaacgtggagctgaagtttgtcgactccattcggcgtcagtttgagttcagtgtggactctttccaaatcatcctggattctttgcttttcttctatgactgttccaataatcccatctctgagcacttccaccccaccgtgattggggagagcatgtacggggactttgaggaagcttttgaccatctgcagaacagactgatcgccaccaagaacccagaagaaatcagaggcgggggacttctcaagtacagcaaccttcttgtgcgggacttcaggcccacagaccaggaagaaatcaaaactctagagcgctacatgtgctccaggttcttcatcgacttcccggacatccttgaacagcagaggaagttggagacttaccttcaaaaccacttcgctgaagaagagagaagcaagtacgactacctcatgatccttcgcagggtggtgaacgagagcaccgtgtgtctcatggggcatgaacgcaggcagactctgaacctcatctccctcctggccttgcgtgtgctggcggaacaaaacatcatccccagtgccaccaacgtcacctgttactaccagccggccccttacgtcagtgatggcaacttcagcaactactacgttgcccatcctccagtcacctacagccagccttaccctacctggctgccctgtaactaaccttgagacctgagggtttccacagtgggaaccccaatagggctagggctctcaggtaggggagcctccttctagatgtaggcatttggcttttaaaggggaactcagctctgattctgcttttttttttttttttcctttgtgtacccattggaatgggtctacagtgtatcatgagccaaccctcaaaggacccgtattacagtgccacgttggaaaacgctacaggaagcatgacctatccacatctttccaagatagacactaacatgtcatgtcccaaacattagcacgtgggggttgagctctgtgcagtaatcgagattgggagaatttgggcagcgcgtgagaagtgctaagctacttgttttctcacttgagcccgggtaggctgtgttggccctcacttgggattctcagcagttacatgaaagttgtgctgataatctcttctcttgtaccaattttagtcaggcagaaaatggtaaacatgagggtgctcttgtgacttaatttttgttcaagggactaaattgcttatgtttattccctgtcagcggagtggagaatgtcattcatcaataaaccaaagccaatagctggagaattgagatctggttgaaagtggtttatggtttacatgctgtactatcctgaggaattgcgagatattgctgaggggaaaaaaaaatgaccttttcttgaaatgtaacttgaaaacaaaataaaatgtggaacataaaaaaaaaaaaaaaaaaaaaaaaaa

SEQ ID NO: 1699 - DNA, 1934 bp, Homo sapiens
  ref <308>: DATABASE ACCESSION NUMBER: NM_017731
  ref <309>: DATABASE ENTRY DATE: 2001-06-18
agctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgccagcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacgtcgcagcctttgctgtctcggcctactcctccacataccaccgagccggctgcaagcccttctccctgcactcaataaaccctcaataaatattctcattgtcaatcagaaaaaaaaaaaaaaaaaaaaa

SEQ ID NO: 1700 - DNA, 2216 bp, Homo sapiens
  ref <308>: DATABASE ACCESSION NUMBER: NM_017732
  ref <309>: DATABASE ENTRY DATE: 2001-06-18
actacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggttagtgatgccctcacctctccccacaagttgtttacccaatggctggaaaggggtggctactggtcatcgtgaccactggagtcaacacagactgatgtacccacagacaccaaaacttgccccctgagttctgaagcaaggggcaaggctgggcccctagcttgtcctgcccattcctccaggtgttgatcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatgagtctgattcaggatgacgtggacctccgtgacacacagaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgaaaaaaaaaaaaaaaaa

SEQ ID NO: 1701 - DNA, 2039 bp, Homo sapiens
  ref <308>: DATABASE ACCESSION NUMBER: NM_017733
  ref <309>: DATABASE ENTRY DATE: 2001-06-18
ccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatataaaaaaaaaaaaaaaaaaaaaaaaaa

SEQ ID NO: 1702 - DNA, 2197 bp, Homo sapiens
  ref <308>: DATABASE ACCESSION NUMBER: NM_017734
  ref <309>: DATABASE ENTRY DATE: 2001-06-18
attacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctctatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcatcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttatttttttcttaagtccaaaaattatcattacagtgtaccatattaagccatgtgaataagtagtagtcattatttgtgaaaaattcccaaaagctggggaaaacaatgtgtaacttttccagttacttgacacgattcagtgggggaaaaccagcattttttattctattgataccaagcatttctaataagagcttgttaaatttaagaataaagttatttaaaataaaaaaaaaaaaaaaaaaaaaaaaaaaa

SEQ ID NO: 1703 - DNA, 3043 bp, Homo sapiens
  ref <308>: DATABASE ACCESSION NUMBER: NM_017746
  ref <309>: DATABASE ENTRY DATE: 2001-06-18
ttttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtgaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcgtctcttactgaatttaacactgtctgatatcatggtctccctggcaaatgcgtcaaccttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgctttaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaaaaaaaaaaaaaaaaaaa

SEQ ID NO: 1704 - DNA, 2426 bp, Homo sapiens
  ref <308>: DATABASE ACCESSION NUMBER: NM_017750
  ref <309>: DATABASE ENTRY DATE: 2001-06-18
atataaagctggttaaggtggtatccagtggagcccctcatgccatcctgttgaaattcctcccattgcccgtggttcagctcctcgacaggtgtgggctgctgacgcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccactccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatctagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaaaaaaaaaaaaaaaaaaaaaaaaaaaaaa

SEQ ID NO: 1705 - DNA, 2129 bp, Homo sapiens
  ref <308>: DATABASE ACCESSION NUMBER: NM_017761
  ref <309>: DATABASE ENTRY DATE: 2001-06-18
ctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacgggtagttgtcaattggtctgaaacaaatttgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaagcataaaattaaataaaatttttccccattgaaaaaaaaaaaaaaaaa

SEQ ID NO: 1706 - DNA, 3802 bp, Homo sapiens
  ref <308>: DATABASE ACCESSION NUMBER: NM_017763
  ref <309>: DATABASE ENTRY DATE: 2001-06-18
aaaaaaaaaaaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccactgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcgtgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggaatgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccggatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaaaaaaaaaaaaaaaaa

SEQ ID NO: 1707 - DNA, 2340 bp, Homo sapiens
  ref <308>: DATABASE ACCESSION NUMBER: NM_017770
  ref <309>: DATABASE ENTRY DATE: 2001-06-18
gatagcgccgggcagagggacccggctaccctggacagcgcatcgccgcccgcccgggtcgccgcgccacagccgctgcggatcatggaacatctaaaggcctttgatgatgaaatcaatgcttttttggacaatatgtttggaccgcgagattctcgagtcagagggtggttcacgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccgggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtttctttggaccaacactgaacagttttgtccacattcttatgtactcctactatggactttctgtgtttccatctatgcacaagtatctttggtggaagaaatatctcacacaggctcagctggtgcagttcgtgctcaccatcacgcacaccatgagcgccgtcgtgaaaccgtgtggcttccccttcggttgtctcatcttccagtcatcttatatgctaacgttagtcatcctcttcttaaatttttatgttcagacataccgaaaaaagccaatgaagaaagatatgcaagagccacctgcagggaaagaagtgaagaatggtttttccaaagcctacttcactgcagcaaatggagtgatgaacaagaaagcacaataaaaatgagtaacagaaaaagcacatatactagcctaacagattggcttgttttaaagcaaagactgaattgaaggttacatgttttaggataaactaatttcttttgagttcataaatcatttgtacccagaatgtattaatatattgctattaggttaatctgttaactgaatgctttgatcagcattgaggtgatgctcacctccgaggacctcagaactggtgcagcttctctctccctccctcccacagactgaacctttcgccagaagctgtccttataacgccttatacgcatacacagccaggaaacgtggagcattgtttctcacagagagtctccaaataaaaagggttttgttcagattaaaatgtttacaacaaaatgttaattatattctaaatacagggtatgttctaatctatattaagcaataatgccagtgcataatcattccatttgttcctttagcaatcaaccccagaaaatattaaaatgggatcatacacagaagatagaaaaatctagcaaaacttctctttctgtaagccagagtcttgtctatcagattcccacaaccactcctgattctaaatttagtgatatggtaatgaaattggtatttattttaaatattagttattctaaggagaaaaaaatgcttctgcaagattttcataattcaggggctgtggataggattgttcctctgtttccctaatcattcatctgttcatgtctccctcttgtgccagtcagcctaggttatacagatgccatgctccacaccacgagcagtgtacaaatctggctgcccgtttactttctgagcaagcactggagtccactccgacctttttctttgaacatgcatgctgctggaatatgtataaatcagaactagcagaagtagcagagtgatgggagcaaaataggcactgaattcgtcaactcttttttgtgagcctacttgtgaatattacctcagatacctgttgtcactcttcacaggttatttaagttcttgaagctgggaggaaaaagatggagtagcttggaaagattccagcactgagccgtgagccggtcatgagccacgataaaaaatgccagtttggcaaactcagcactcctgttccctgctcaggtatatgcgatctctactgagaagcaagcacaaaagtagaccaaagtattaatgagtatttcctttctccataagtgcaggactgttactcactactaaactctaccaagaatggaaaccaagaatattttctgaagatttttttgaagattaatttataccctataaaataaaacttgttagcttcgatgaagtcaaaaaaaaaaaaaaaaaaaaa

SEQ ID NO: 1708 - DNA, 2396 bp, Homo sapiens
  ref <308>: DATABASE ACCESSION NUMBER: NM_017779
  ref <309>: DATABASE ENTRY DATE: 2001-06-18
gtgccgagactcaccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaatgatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttactagactgctagtggataataacatcttgactacttaaaaaagggacatattgaaaatcctggagatggactatttgctcctttgcctaacttactcatactgtaagcagattagtgctcaggagtttgatgagcaaaaagtttctacctctcaagctgcaattgctagaactctttagaaaatattattaaaatacaggagtttaccttaaaggaaaaaaaaaaaacaaaaaaaaaaaaaaaaaa

SEQ ID NO: 1709 - DNA, 3082 bp, Homo sapiens
  ref <308>: DATABASE ACCESSION NUMBER: NM_017780
  ref <309>: DATABASE ENTRY DATE: 2001-06-18
catttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctctgaaaactgctatcatgtaagataaaatgtaaattgctgccaactgtagtaatgatgcttttaataaaagtgacccatgatatgcagagatgtaaaaaaaaaaaaaaaaaaaaaaaaaaa

SEQ ID NO: 1710 - DNA, 3041 bp, Homo sapiens
  ref <308>: DATABASE ACCESSION NUMBER: NM_017782
  ref <309>: DATABASE ENTRY DATE: 2001-06-18
caatgctacattaacccattatgtaagaccaataaatgcagagccagcgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagccgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagctgtggagtcagatcccagaccacagggacagcccaggagaggctacacagccagcagtctggacatctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaatagtggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacgaatagctttgtttttgctatgctaatgtctagaaaggcatacgatgctactattatgctctgttttaaaggttttacctacccttgtaaaaactataatcttaaatggttttatttgctgtttactacttatacatactactactataaaactattttttcctaaatggtacaaatttataaactatcatttttcacttacggtatttgtaaatactactactacaaaaatcagctttccgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaaaaaaaaaaaaaaaaa

SEQ ID NO: 1711 - DNA, 2774 bp, Homo sapiens
  ref <308>: DATABASE ACCESSION NUMBER: NM_017786
  ref <309>: DATABASE ENTRY DATE: 2001-06-18
ttttttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggctcctcctcctggacagcgcgatggggcccttctgggcgagaaaggatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacaggtttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaagtcttaaatggcttgtttgttcttaaactgttaattgatgaaactgtgcataagtttacatgtactaacttattttgcttattatatatagtgttttattggaaattgtaaccacacacttcagcatgatgaaaataaagattagtgtttccatttaaataaatgttttatcctcccataaaaaaaaaaaaaaaaaaa

SEQ ID NO: 1712 - DNA, 3614 bp, Homo sapiens
  ref <308>: DATABASE ACCESSION NUMBER: NM_017791
  ref <309>: DATABASE ENTRY DATE: 2001-06-18
aaggagagaacttttcctgcacaaggaacgcctcgtggggagacccaaggcaggagcggtccggagccggctgcggcgtgtgcggccggccttgggacagcgatcgccgcgggtggcaacagagagccccaagcaaaagtgggagcaggagcttggaggtgagcacaggaagccccacttgaggcttttacgcagcctctagtctctgtttcttctggaataggcaagcgtcctttcaactctaagagaccagcagaggccactgtcccttaagactgccggagtcctcaccacttctccaggattccagaggagactgtggcgatggtgaatgaaggtcccaaccaggaagagagcgatgacacccctgcgccggagtccgcactccaagcggaccccagcgtctcggtccatcccagcgtctcggtccatcccagcgtctccatcaaccccagcgtctctgtccaccccagcagttcggcccaccccagtgccttagcccaacccagtggcttggctcaccccagtagctcgggccctgaggacctcagcgtgatcaaggtgagcaggcgccgttgggccgtggtcctggtgtttagctgctactccatgtgcaactcctttcagtggatccagtacggctccatcaataacatcttcatgcacttctacggtgtcagtgcctttgccattgactggctgtccatgtgctacatgctgacttacatccctctgctcctgccagtggcttggctgctggagaagttcggcctgcgcaccattgctctcactggctcggctctcaactgcctgggggcctgggtgaagctgggcagcctgaagccgcatctctttccggtcaccgtagtgggccagctcatctgctctgtggcccaggttttcatcctgggcatgccctcccgcatcgcttccgtctggttcggggctaatgaggtttcaacagcctgctcggtggctgtctttggcaatcagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctccttcggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaatgtttaccaaacctattgctttattttaaaaacataatttgtgttttctatttgtaagatctgacatttcgaggccaataaaaacttctcagaaaaaaaaaaaaaaaaa

SEQ ID NO: 1713 - DNA, 1457 bp, Homo sapiens
  ref <308>: DATABASE ACCESSION NUMBER: NM_017805
  ref <309>: DATABASE ENTRY DATE: 2001-06-18
agccgccggctcgggagacctgccgcccctcgggcccgccacgctgctggcgctgtgcgtgcagcattccgcccgtgagctggagctgggccacctgccacgactgctgggccgcctggcccggctcatcaaggaggccgtctgggaaaagattaaggaaattggagaccgtcagccagaaaaccaccctgagggggtccccgaggtgcccctgactcctgaagctgtgtctgtggagctgcggccactcatgctgtggatggccaacaccacggagctgcttagctttgtgcaggagaaggtgctggaaatggagaaggaggctgaccaagaggacccacagctctgcaatgacttggaattatgtgatgaggccatggccctcctggatgaggtcatcatgtgtaccttccagcagtctgtctactacctcaccaagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggcaaaaaaaaaaaaaaaaaaaaaaaaaaaaaaaaaaaaaaaaa

SEQ ID NO: 1714 - DNA, 1598 bp, Homo sapiens
  ref <308>: DATABASE ACCESSION NUMBER: NM_017816
  ref <309>: DATABASE ENTRY DATE: 2001-06-18
agctgcggcgctgggctggcggcggcgagtccacgtgctccccgcggccggttgaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1715 - DNA, 1573 bp, Homo sapiens
  ref <308>: DATABASE ACCESSION NUMBER: NM_017821
  ref <309>: DATABASE ENTRY DATE: 2001-06-18
gagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaactacaaagatgagaaattaccagaagcctcgccttttcctaagcaccagcggaaggagctgtgccccgggatggagtgagggtggagggcgcgtcagccacgggtgggccttgtgtcgcctcgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcaaaaaaaaaaaaaaaa

SEQ ID NO: 1716 - DNA, 1245 bp, Homo sapiens
  ref <308>: DATABASE ACCESSION NUMBER: NM_017835
  ref <309>: DATABASE ENTRY DATE: 2001-06-18
cttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaaa

SEQ ID NO: 1717 - DNA, 831 bp, Homo sapiens
  ref <308>: DATABASE ACCESSION NUMBER: NM_017843
  ref <309>: DATABASE ENTRY DATE: 2001-06-18
gcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacgtggagtgcagtggcacaatcccagctcgctgcaacctccgcctcccgggttcaagtgattctcctgcctccgcctcccaagtagctgggattacagaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggtttttttctttgtattgctgtttattttatattttaaaaatatttaaaaaaaaaaaaaaaaaaaaaaaaaaaaaaaaaaaaaaaaaaaaaaaaaa

SEQ ID NO: 1718 - DNA, 2064 bp, Homo sapiens
  ref <308>: DATABASE ACCESSION NUMBER: NM_017857
  ref <309>: DATABASE ENTRY DATE: 2001-06-18
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttattaaaaaaaaaaaaaaaaaa

SEQ ID NO: 1719 - DNA, 1662 bp, Homo sapiens
  ref <308>: DATABASE ACCESSION NUMBER: NM_017901
  ref <309>: DATABASE ENTRY DATE: 2001-06-18
ttgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatctctagcacattactaaaagagcctctgctttgtaaaaaaaaaaaaaaaaaaaaaaaaaaaa

SEQ ID NO: 1720 - DNA, 1554 bp, Homo sapiens
  ref <308>: DATABASE ACCESSION NUMBER: NM_017906
  ref <309>: DATABASE ENTRY DATE: 2001-06-18
aattatatatttttactctatgtttctctacatgtttttttctttccgttgctggcggaagaggcacgtgcgctgctgaatggagctggtcgctggttgctacgagcaggtcctctttgggttcgctgtacacccggagcccaaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaatttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctcaaaaaaaaaaaaaaaaa

SEQ ID NO: 1721 - DNA, 976 bp, Homo sapiens
  ref <308>: DATABASE ACCESSION NUMBER: NM_017918
  ref <309>: DATABASE ENTRY DATE: 2001-06-18
gaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggttttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacaaaaaaaaaaaaaaaaaaa

SEQ ID NO: 1722 - DNA, 1480 bp, Homo sapiens
  ref <308>: DATABASE ACCESSION NUMBER: NM_017961
  ref <309>: DATABASE ENTRY DATE: 2001-06-18
gctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgtcattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaagagtttcagtactaagcaattttagtctctgcagtctcttgtcttgaattaatacaacttttgttaattctcttatgaagttaatcttcctgcttgtatgtgaattaaatatatgtcaaactttttttgtaaaaaaa

SEQ ID NO: 1723 - DNA, 1595 bp, Homo sapiens
  ref <308>: DATABASE ACCESSION NUMBER: NM_017996
  ref <309>: DATABASE ENTRY DATE: 2001-06-18
acagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 1724 - DNA, 1534 bp, Homo sapiens
  ref <308>: DATABASE ACCESSION NUMBER: NM_018000
  ref <309>: DATABASE ENTRY DATE: 2001-06-18
tttgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgccggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccagtattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaacaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 1725 - DNA, 1564 bp, Homo sapiens
  ref <308>: DATABASE ACCESSION NUMBER: NM_018004
  ref <309>: DATABASE ENTRY DATE: 2001-06-18
gaagcacatctggacagctgtgcggcctccttgcgggccgacgtcagccgagcacgtcccccacgtcctctccttctcgccacttattatttattcgttttcccaaagaagcgactagggacccaagtttaaaaattcctccccccactcaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgc

SEQ ID NO: 1726 - DNA, 1734 bp, Homo sapiens
  ref <308>: DATABASE ACCESSION NUMBER: NM_018011
  ref <309>: DATABASE ENTRY DATE: 2001-06-18
attgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacagaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgcttgctacatcataatgctggttttgctgactttttgtttttttatatatttataaaaaaagaaaaagttggtgattgcattgggaaattcccagggtattactggacctatgtggtgtattgttaaaccagtgtccttgtgatactgtcgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattc

SEQ ID NO: 1727 - DNA, 2398 bp, Homo sapiens
  ref <308>: DATABASE ACCESSION NUMBER: NM_018014
  ref <309>: DATABASE ENTRY DATE: 2001-06-18
gcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttcttttcctttatgttctcaccgtttgaatgcatgatctgtacggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttatttttttttaaacaatgattaaattgaatgtgtaatgtgcaaaagccctggaacgcaattaaatacactagtaaggagttcattttatgaagatatttgctttaataatgcctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaact

SEQ ID NO: 1728 - DNA, 1809 bp, Homo sapiens
  ref <308>: DATABASE ACCESSION NUMBER: NM_018022
  ref <309>: DATABASE ENTRY DATE: 2001-06-18
acgccggcgctcccaggccgcgcttcctgcgtccccaacccggtccctgagagggcactgcgccctctccaccactgcgttccctcggctaagaatcccccgaaccccagccccgcgatcgcggcgcccaccgaggaggccgcccgggtggggcgcgggggtcgcgaagcccgcagccccggaccgcccagccgagacggagccggacccgccgcctcccgggcccttccaccgcagctatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcgggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaaattttgtgtttgctgtctacgctggagtcctgaactgtgggtagaaaacacgacctggctttgtagaaaggacacagggctgttttatgaactaagcggtgaggctcaggtggcggctctcacagagcccctgatgctgttgttctttgagggcttaaggcctgatgaacgtaggcacgtgatgcgtaatagtcttcaatggtacacttaactagtctcttctgtgtaacagc

SEQ ID NO: 1729 - DNA, 4079 bp, Homo sapiens
  ref <308>: DATABASE ACCESSION NUMBER: NM_018031
  ref <309>: DATABASE ENTRY DATE: 2001-06-18
cttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagaggtcaaaaaaaaaa

SEQ ID NO: 1730 - DNA, 3052 bp, Homo sapiens
  ref <308>: DATABASE ACCESSION NUMBER: NM_018043
  ref <309>: DATABASE ENTRY DATE: 2001-06-18
ggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacaggatctccatggccgccgccttggccatgaactcctccccctccgtgcggtccaacatccgggtcacagtcacagccaccgcggtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctc

SEQ ID NO: 1731 - DNA, 771 bp, Homo sapiens
  ref <308>: DATABASE ACCESSION NUMBER: NM_018048
  ref <309>: DATABASE ENTRY DATE: 2001-06-18
gtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctg

SEQ ID NO: 1732 - DNA, 1678 bp, Homo sapiens
  ref <308>: DATABASE ACCESSION NUMBER: NM_018062
  ref <309>: DATABASE ENTRY DATE: 2001-06-18
agagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcaccctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaag

SEQ ID NO: 1733 - DNA, 2008 bp, Homo sapiens
  ref <308>: DATABASE ACCESSION NUMBER: NM_018069
  ref <309>: DATABASE ENTRY DATE: 2001-06-18
acaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttcctgccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacgtaagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatatttt

SEQ ID NO: 1734 - DNA, 1344 bp, Homo sapiens
  ref <308>: DATABASE ACCESSION NUMBER: NM_018072
  ref <309>: DATABASE ENTRY DATE: 2001-06-18
ccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggtgatgaagaaggaagagctcacctcccatcagtctcagctaaccgcctttttcctggaggccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgaaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagaagccttgatgatgcctctggtggatcagctggaaaacaggcttgggggagaagagaaattccaggaacgggtgacaaagcacctgataccatgcatcgcacagttttcggtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttctttacaaaatccccacctggcttgtgctgccacataagcctctcctgcctatcgtatagagctgcagaaagagtaaatgatacacggtatttttatacag

SEQ ID NO: 1735 - DNA, 2809 bp, Homo sapiens
  ref <308>: DATABASE ACCESSION NUMBER: NM_018077
  ref <309>: DATABASE ENTRY DATE: 2001-06-18
acttccggaatctctcggcgtgtgagcttggttgtcctaccaaagccagcgtttcggctcgcgtgcgccggcctagtttgctcgcgccctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcggaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaattttttattctttatttctcaaatggaaacacctgaaaaagcattctggagtgctgaatttttaagatgtatattttgttaagcatattctctaaatgagatattgtgtggctttttagtaacaacgtcatttctaat

SEQ ID NO: 1736 - DNA, 2094 bp, Homo sapiens
  ref <308>: DATABASE ACCESSION NUMBER: NM_018086
  ref <309>: DATABASE ENTRY DATE: 2001-06-18
cctactaaaaaaaatgcagagaagtattccggcattttggaaggtcctgtggaccgacccgtactcagcaactattcggacacaccatcaggactagtgaacggtcggaaaaatgaaagtgaaccctggcagccttccttgaattcagaagctgtttatcccatgaactgtgttccggatgttatcactgccagcaaagctggagtcagttcagccctccctccagcagatgtctctgcgagtataggaagctctcctggggtagccagcaacctgacagaacctagttattcaagtagtacctgtggaagccacactgtacccagtcttcatgcagggctcccatctcaggaatatgccccaggatacaacggatcatatttgcattctacttatagtagccagccagcacctgcacttccttcacctcatccgtctcctttgcatagctctgggctactacagcccccaccaccacctcctccgccaccagccttggtcccaggctacaatgggacttctaacctctccagttacagctatccgtctgctagctatcctcctcagactgctgtggggtctgggtacagccctgggggggcaccgcctccgccttcagcgtacctgccttcaggaattcctgctcccacccccctaccccccaccactgttcctggctacacctaccagggccatggtttgacacctattgcaccgtcggctctgacaaacagttcagcaagttctctcaaaaggaaagctttctacatggcagggcaaggagatatggactccagttatggaaattacagctatggccaacagagatctacacagagtcctatgtacagaatgcccgacaacagcatttcaaacacaaatcgggggaatggctttgacagaagtgctgaaacatcatccttagcatttaagccaacgaagcagctaatgtcctctgaacagcaaaggaaattcagcagccagtccagtagggctctgacccctccttcctacagtactgctaaaaattcattgggatcaagatccagtgaatcctttgggaagtacacatcgccagtaatgagtgagcatggggacgagcacaggcagctcctctctcacccaatgcaaggccctggactccgtgcagctacctcatccaaccactctgtggacgagcaactgaagaatactgacacgcacctcatcgacctggtaaccaatgagattatcacccaaggacctccagtggactggaatgacattgctggtctcgacctggtgaaggctgtcattaaagaggaggttttatggccagtgttgaggtcagacgcgttcagtggactgacggccttacctcggagcatccttttatttggacctcgggggacaggcaaaacattattgggcagatgcatcgctagtcagctgggggccacatttttcaaaattgccggttctggactagtcgccaagtggttaggagaagcagagaaaattatccatgcctcttttcttgtggccaggtgtcgccagccctcggtgatttttgttagtgacattgacatgcttctctcctctcaagtgaatgaggaacatagtccagtcagtcggatgagaaccgaatttctgatgcaactggacactgtactaacttcggctgaggaccaaatcgtagtaatttgtgccaccagtaaaccagaagaaatagatgaatcccttcggaggtacttcatgaaacgacttttaatcccacttcctgacagcacagcgaggcaccagataatagtacaactgctctcacagcacaattactgtctcaatgacaaggagtttgcactgctcgtccagcgcacagaaggcttttctggactagatgtggctcatttgtgtcaggaagcagtggtgggccccctccatgccatgccagccacagacctttcagccattatgcccagccagttgaggcccgttacatatcaagactttgaaaatgctttctgcaagattcagcctagcatatctcaaaaggagcttgatatgtatgttgaatggaacaaaatgtttggttgcagtcagtgataacttctttag

SEQ ID NO: 1737 - DNA, 2450 bp, Homo sapiens
  ref <308>: DATABASE ACCESSION NUMBER: NM_018087
  ref <309>: DATABASE ENTRY DATE: 2001-06-18
gagcttgtccagacgaagcctcgcagggatgggttggagcctgggccgtgcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttag

SEQ ID NO: 1738 - DNA, 1366 bp, Homo sapiens
  ref <308>: DATABASE ACCESSION NUMBER: NM_018093
  ref <309>: DATABASE ENTRY DATE: 2001-06-18
tagtaataccagctgtaatcccagctacttgggaggctgaggcagaagaatcgcttgaacccgggaggcggaggttgagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacctcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtactcactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacgggacccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccc

SEQ ID NO: 1739 - DNA, 1978 bp, Homo sapiens
  ref <308>: DATABASE ACCESSION NUMBER: NM_018098
  ref <309>: DATABASE ENTRY DATE: 2001-06-18
atcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagggtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaggaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaaccc

SEQ ID NO: 1740 - DNA, 1973 bp, Homo sapiens
  ref <308>: DATABASE ACCESSION NUMBER: NM_018099
  ref <309>: DATABASE ENTRY DATE: 2001-06-18
gaaagactggagccgtttccttgtggctggagcgcttcccgtagcctcggggaaggagcaggatttagaggaccactagttggaccccatcctcgtgctggaggaacaggaacctctttcaggagctataaaagaaaggggggaatcatgtccacaattgcagctttctatggcggcaagtccatcctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttacctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagggtattcaactttgacgtgcgccagttgaactggttggaatacattgaaaattatgttttgggagttaaaaaatacttattgaaagaggatatggctgggatcccaaaggcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgccttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcctttgcgtattaaacgtgaaagtactccc

SEQ ID NO: 1741 - DNA, 2307 bp, Homo sapiens
  ref <308>: DATABASE ACCESSION NUMBER: NM_018101
  ref <309>: DATABASE ENTRY DATE: 2001-06-18
gtgactgtggagtttgaattgggtggcggttgactgtagagccgctctctctcactggcacagcgaggttttgctcagcccttgtctcgggaccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttctgt

SEQ ID NO: 1742 - DNA, 2410 bp, Homo sapiens
  ref <308>: DATABASE ACCESSION NUMBER: NM_018103
  ref <309>: DATABASE ENTRY DATE: 2001-06-18
attctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgtcactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatctgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactat

SEQ ID NO: 1743 - DNA, 3614 bp, Homo sapiens
  ref <308>: DATABASE ACCESSION NUMBER: NM_018104
  ref <309>: DATABASE ENTRY DATE: 2001-06-18
agttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaacttt

SEQ ID NO: 1744 - DNA, 2084 bp, Homo sapiens
  ref <308>: DATABASE ACCESSION NUMBER: NM_018109
  ref <309>: DATABASE ENTRY DATE: 2001-06-18
agcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctct

SEQ ID NO: 1745 - DNA, 2149 bp, Homo sapiens
  ref <308>: DATABASE ACCESSION NUMBER: NM_018120
  ref <309>: DATABASE ENTRY DATE: 2001-06-18
agcgccttcgctctttggctccctgagttagtccggttgtttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaaaactacaactccaggagaaacaaaacttctggcctctgaaatctatgacattcttcagtcctccaatatggcagatggtgatagttttaatgagatgaattcacgtcgaaggaaagctcaattttttctgggaactacaaacaaacgtgccaaaacagtggttttgcatatagatggccttgatgatacgtctcggagaaatctatgtgaagaggctttgttaaaaattaaaggtgttattagctttacttttcaaatggctgttcaaaggtgtgtggtgcgaatccgttcagatttgaaagctgaggctttggcatcagcaatagcatcaaccaaggttatgaaagctcagcaagttgtgaaaagtgaaagtggagaagagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacattttattggacattttaccccactgagtggtaaaaaggacagaggctacagatggagttgctttgtttatgaaagtattttggtttgttttctttcatttaattgcctcatatttaaaaaccatgggtccactgttaaaaccacatgtgtatgtgcagctttacattttattttacgtgaagcatgtgattaggaaaactcattttcttttcaagcctcaggacctacctgaagagaagttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttccttgtattgtcttttgtgaatttattatgaaaatgctgcgttgtgttgaatgaaaaagacccaaattactgcttatgaagaaataaagccagcattgatcactt

SEQ ID NO: 1746 - DNA, 3887 bp, Homo sapiens
  ref <308>: DATABASE ACCESSION NUMBER: NM_018123
  ref <309>: DATABASE ENTRY DATE: 2001-06-18
gcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaaaaaaaaatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgt

SEQ ID NO: 1747 - DNA, 2232 bp, Homo sapiens
  ref <308>: DATABASE ACCESSION NUMBER: NM_018131
  ref <309>: DATABASE ENTRY DATE: 2001-06-18
gaaattgcacacttaaagacatcagtggatgaaatcacaagtgggaaaggaaagctgactgataaagagagacagagacttttggagaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtctctttacacatctctgctaaagcagcaagaagaacaaacaagggtagctctgttggaacaacagatgcaggcatgtactttagactttgaaaatgaaaaactcgaccgtcaacatgtgcagcatcaattgcatgtaattcttaaggagctccgaaaagcaagaaaaaataacacagttggaatccttgaaacagcttcatgagtttgccatcacagagccattagtcactttccaaggagagactgaaaacagagaaaaagttgccgcctcaccaaaaagtcccactgctgcactcaatggaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagatactaacattttgcactgtcaaaatacttggtgaggaaaagatagctcaggttattgctaatgggttaatgcaccagcaagcaaaatattttatgtttcgggggttttgaaaaatcaaagataattaaccaaggatcttaactgtgttcgcattttttatccaagcacttagaaaacctacaatcctaattttgatgtccattgttaagaggtggtgatagatactatttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgtttt

SEQ ID NO: 1748 - DNA, 2414 bp, Homo sapiens
  ref <308>: DATABASE ACCESSION NUMBER: NM_018136
  ref <309>: DATABASE ENTRY DATE: 2001-06-18
gaaatctgtacgaactattcaggctgcttttagaggcatgaaagttagacaaaaattgaaaaatgtatcagaggaaaagatggcagccattgttaaccaatctgcactctgctgttacagaagcaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctgtattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctctcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctctgtgtacaacttttaaaatctgactttgttttaaaaaaacataaactgttcattacattcttcatttttatcatttatagttttatgcatgtaataaactaatatgtcataagatg

SEQ ID NO: 1749 - DNA, 2415 bp, Homo sapiens
  ref <308>: DATABASE ACCESSION NUMBER: NM_018138
  ref <309>: DATABASE ENTRY DATE: 2001-06-18
aaaagacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttccaggtactggtagagaacaagttttatgaatggttgattaatacaggacatcgccaacagctggacagccttgtaccccctgcagcaggctccaaacaagcagctggataaggatcttacatgcagacactgggccctggaaatacaaggataaatggaggatggtgctcatcttgaaacttgaaactaaattgggaaggtgctattgctgcttaagagacattgggacttttctgtcttttttttttttttttttttgaggcagagtcttgttctgtcgcccaggctggcgtgcagtggcgcgatctcggctcactgcaagctctgcctcccgggttcacgccattctcctgcctcagcctcctgagtagctgggactacaggcgcccgccaccacgcccggccaattttttttgtatttttagtagagacggggtttcaccgtgttagtcaggatggtctcgatctcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcatctttgtgatgcccaaatgaaaaagttggtgaaggtagtaccattgtatgtatgttaatattaaagcaactgagtgtagatttgc

SEQ ID NO: 1750 - DNA, 1054 bp, Homo sapiens
  ref <308>: DATABASE ACCESSION NUMBER: NM_018166
  ref <309>: DATABASE ENTRY DATE: 2001-06-18
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttacttgatctgcgaagtggggataatggtatcacgtcgcagggttgtcaggcggagctggtaggggagctgccccccagagcagcatggatgccccgcgaagggacatggagttgctcagcaacagcctggctgcctacgcgcacatccgcgccaaccccgagagctttggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccctggctcccgccgcaaggcgctcggggtaccggacctgtacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtg

SEQ ID NO: 1751 - DNA, 2631 bp, Homo sapiens
  ref <308>: DATABASE ACCESSION NUMBER: NM_018171
  ref <309>: DATABASE ENTRY DATE: 2001-06-18
accttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaaccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccgccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggagcgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagccaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgatggaaaatatgtactgttaaacgatcaaccagatgacgatgatggaaatccaaatgaacatagaggcgcagaatccgaagcataactcacttgcgcctgtgggggaagagcgaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagc

SEQ ID NO: 1752 - DNA, 2792 bp, Homo sapiens
  ref <308>: DATABASE ACCESSION NUMBER: NM_018178
  ref <309>: DATABASE ENTRY DATE: 2001-06-18
attgcttctgggactaaaagataaagaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgcgatgagatgttttcatcatttttgtttccttttcttgaatcagacttgtgatttggggagagcaacttcagggcttctccatagaccttgaccattataagcagaccttatttctccctacacttccactccataggtaaataaactgggtgaacccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttcttttgagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaactcttccacctcagcctcccaaagtgctgagattactggcttgagccactgcacccacccctccagactactttaaatgtctctgctctgactgagttgaaggaattgtaagtttcagttgctgaatatatcagtatatctgaactccggatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctcactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctc

SEQ ID NO: 1753 - DNA, 3354 bp, Homo sapiens
  ref <308>: DATABASE ACCESSION NUMBER: NM_018181
  ref <309>: DATABASE ENTRY DATE: 2001-06-18
taattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 1754 - DNA, 2732 bp, Homo sapiens
  ref <308>: DATABASE ACCESSION NUMBER: NM_018186
  ref <309>: DATABASE ENTRY DATE: 2001-06-18
gaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagaccttgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagtt

SEQ ID NO: 1755 - DNA, 3334 bp, Homo sapiens
  ref <308>: DATABASE ACCESSION NUMBER: NM_018187
  ref <309>: DATABASE ENTRY DATE: 2001-06-18
atgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagcccctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacaccggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaattt

SEQ ID NO: 1756 - DNA, 2485 bp, Homo sapiens
  ref <308>: DATABASE ACCESSION NUMBER: NM_018188
  ref <309>: DATABASE ENTRY DATE: 2001-06-18
aaaaaaaaaaaaaaaaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcggcttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccttccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgaccccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctcatt

SEQ ID NO: 1757 - DNA, 3598 bp, Homo sapiens
  ref <308>: DATABASE ACCESSION NUMBER: NM_018194
  ref <309>: DATABASE ENTRY DATE: 2001-06-18
aaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgccgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctctactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcgatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtcattgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggatttttttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattgtgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 1758 - DNA, 2330 bp, Homo sapiens
  ref <308>: DATABASE ACCESSION NUMBER: NM_018204
  ref <309>: DATABASE ENTRY DATE: 2001-06-18
aataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtccaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaagagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtataatt

SEQ ID NO: 1759 - DNA, 2430 bp, Homo sapiens
  ref <308>: DATABASE ACCESSION NUMBER: NM_018208
  ref <309>: DATABASE ENTRY DATE: 2001-06-18
gctagcgtctgccgcggctccgagggggtggggctgctgggaatggctgtgcccccttcggcccctcagcagcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgg

SEQ ID NO: 1760 - DNA, 2943 bp, Homo sapiens
  ref <308>: DATABASE ACCESSION NUMBER: NM_018212
  ref <309>: DATABASE ENTRY DATE: 2001-06-18
ccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttctgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgggctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgac

SEQ ID NO: 1761 - DNA, 3106 bp, Homo sapiens
  ref <308>: DATABASE ACCESSION NUMBER: NM_018222
  ref <309>: DATABASE ENTRY DATE: 2001-06-18
cagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacat

SEQ ID NO: 1762 - DNA, 3369 bp, Homo sapiens
  ref <308>: DATABASE ACCESSION NUMBER: NM_018228
  ref <309>: DATABASE ENTRY DATE: 2001-06-18
agatatgaaactggttctggagtgagatgagctcggctggggacgctacttgagaaggcctttccccacagggtgacttaaatgtcccaggctggaaggtggagcgagaagtggatgcccccagggctctgggtcacactccaggatgacttctcggaaccagctggtgcagaaggtgctgcaggagctgcaggaagcagtggagtgcgaaggcctggagggtctcataggtgcttccttggaggccaagcaggtcctgtcttccttcactctccccacctgccgggagggaggccctggcctccaggtgctggaagtggactcggtggccctgagcctgtatccagaagatgctccacggaacatgctgccgctggtgtgcaagggggagggcagcctgctgttcgaggcggccagcatgctgctgtggggtgacgcaggcctcagcctggagctgcgggcccgcaccgtggtagagatgctgctgcacagacactactacctccagggcatgatcgactccaaagtgatgctgcaggccgtgcgctactccctatgctctgaggagtcccctgagatgaccagcttgccccccgccacgctggaggccatcttcgatgccgacgtcaaggcctcctgtttccccagcagcttctccaacgtgtggcacttgtatgctctcgcctctgtcctccagcggaacatctactccatctaccccatgcgcaacctcaagatccggccctacttcaaccgtgtcatccggccccgccgctgcgaccacgtgccctccacgctgcacatcatgtgggctggccagcccctcaccagccacttcttccgccaccagtactttgcccctgtggtggggctggaagaggtggaggctgaaggtgcccctggcgtggccccagctcttccagccctggccccactctcatcgccggccaagaccctggagctgctcaaccgtgaacctggcctcagctactctcacctctgtgagcgctacagcgtcaccaaaagcaccttctaccgctggcggcggcagtcccaggagcaccggcagaaggttgctgcccgcttctccgccaagcacttcctgcaggacagcttccaccgggggggcgtcgtgccacttcagcagttcctccagcggttcccggagatctcccgctcaacctactatgtctggaagcatgagctgctgggctctggcacctgcccggccttgccccccagggaggtgctgggcatggaggagctagagaagctgccggaggagcaggtggctgaggaggagctggagtgctccgcactggcggtgtcaagccctggaatggtcttaatgcagcgggccaagttgtacctggagcattgcatctccctgaacacactggtaccctatcgctgcttcaaacgcaggttccctggcatctcacggtccacttattataattggcggcgaaaggccctccggaggaaccccagcttcaagccggcaccagccctctctgctgctgggactccccagctagcatctgttggggaaggggctgtaattccttggaagagtgaggcggaagagggggcagggaatgccacaggtgaggaccctcccgcccccggggagctcctgccactaaggatgcccctgtcccgttggcagaggcgtctgcgcagggctgcccgcaggcaggtgctgagtgggcatctccctttctgccgcttccgcctccgctaccccagcctgtcaccttctgccttttgggtctggaagagtcttgctcggggttggcccagaggcctgtccaaacttcaggtgccggtccccaccttgggcaaaggggggcaggaggctgaggagaagcaggagaaggaggctggcagggatgtgacagctgtgatggccccacctgtgggggcttcttcagaagatgtagagggagggccttccagagagggggccctgcaggagggggccacagcccagggccagccccacagtgggcccttgctgagccaacctgtggtggcagcagcgggtggcagggatggccggatgctggtgatggacatgatcgctaccacgaagttcaaggcccaggccaagctgttcttgcagaagcgcttccagtccaagagctttccctcctacaaggagttcagtgccctctttcccctcactgcccgctccacatactacatgtggaagcgagccctctatgacggcctgaccctggtagatggctgacagggaggtacaaaaggggctgggaagaagggggaccagtttggagagggtcagggacctgagctgaccccaggcttggccaggatgtcctttgctctgggtcccacagtgtctaccctaagtccaagggtatatttgtgttattttctggctccaggacagagaatgccagaaatcagccatctggtctcccgtaggaaactgtgggaccagagatatcctctttcgttgtttgctggtcatatttttactgttatgatttagtttttggttttgatttgagtgggttggttggcccccttgctggagttggaagccgtatgtatgtcagggggtttagaggggggttggttagctagagctgctttcagcttttcctggagacaaaaggagtgttatagcatgatcatcggtcccactgggcagaacgttatcttcagtttcttttgggggttggcatcctctttactcagttgtttcccaaaggaacattaggctcgaatatgggggccaggtgtggtggcttatgcctgtaatcctagcgctttgggaggccaaggcaggaggatcacttgaggctaggagttagagaccaccctgggcaatgtagtgagacctcatctcttagaaaaaaaaaaagaaagaaaatcaaatgtagagctgatcagcagcttgtgcctggcatccccaagggagaaggtgccaggtcagcaggagcagcagcagggatgtatagaaagaaccacagctggcctctaaaggatggcactgaggcaccggagatcttgaggcactggagatcactgaggggctggcctgtcccctgcaaggagtgtgggaccaggtggggcaaggctgggagatgcaggctctgtttgcagattatggcccagagtctctgcttgtgggtgcttgatccacctgctgggaccctgcagtcctcggccagcctggctgtcagttggggattccacctttctgctgagcgccttctcggagctggaggcccatcttcagtgagagatcacaaagcggccaggcaggtgggagactgaatttgccttgttcgagagtaacgtttgaaaaccaaagaaataaagtgatgcagtgcccac

SEQ ID NO: 1763 - DNA, 3912 bp, Homo sapiens
  ref <308>: DATABASE ACCESSION NUMBER: NM_018234
  ref <309>: DATABASE ENTRY DATE: 2001-06-18
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtatccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctgggggggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccctccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgc

SEQ ID NO: 1764 - DNA, 2494 bp, Homo sapiens
  ref <308>: DATABASE ACCESSION NUMBER: NM_018255
  ref <309>: DATABASE ENTRY DATE: 2001-06-18
agttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgg

SEQ ID NO: 1765 - DNA, 3655 bp, Homo sapiens
  ref <308>: DATABASE ACCESSION NUMBER: NM_018257
  ref <309>: DATABASE ENTRY DATE: 2001-06-18
gttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgaagagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttttaggacatcttttgatacctttaaaagaaccactgtcaagtaatccttaaaaaaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgc

SEQ ID NO: 1766 - DNA, 4098 bp, Homo sapiens
  ref <308>: DATABASE ACCESSION NUMBER: NM_018265
  ref <309>: DATABASE ENTRY DATE: 2001-06-18
atgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgtggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctaagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctggacatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttctgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggtttttgaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctg

SEQ ID NO: 1767 - DNA, 1595 bp, Homo sapiens
  ref <308>: DATABASE ACCESSION NUMBER: NM_018271
  ref <309>: DATABASE ENTRY DATE: 2001-06-18
ggttggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtgatgg

SEQ ID NO: 1768 - DNA, 2331 bp, Homo sapiens
  ref <308>: DATABASE ACCESSION NUMBER: NM_018290
  ref <309>: DATABASE ENTRY DATE: 2001-06-18
aaaaacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatggtaactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatc

SEQ ID NO: 1769 - DNA, 1680 bp, Homo sapiens
  ref <308>: DATABASE ACCESSION NUMBER: NM_018295
  ref <309>: DATABASE ENTRY DATE: 2001-06-18
agagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcggtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatagtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgccgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggttgcgcacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgt

SEQ ID NO: 1770 - DNA, 2334 bp, Homo sapiens
  ref <308>: DATABASE ACCESSION NUMBER: NM_018304
  ref <309>: DATABASE ENTRY DATE: 2001-06-18
ctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagcttcaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggaggccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcgcacctgtaatcccagcactttgggaggctgaggcaggtggatcacctgaggtcgggagtttgagaccagcctggccaacatggtgaaatcccatctctactgaaaatacagaattggccgggtgtggtgtcacgcgcctgtggtcccagttacttgaacctgggaggcggaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 1771 - DNA, 1529 bp, Homo sapiens
  ref <308>: DATABASE ACCESSION NUMBER: NM_018306
  ref <309>: DATABASE ENTRY DATE: 2001-06-18
atagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagacgggaaggctggactcttttcccaagaacaatatgagagaaacaagtcttcttcctcctccttctcttcctcctcatcctcctcatcttcttcatcctcctcctcctcaggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacgactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaatt

SEQ ID NO: 1772 - DNA, 1926 bp, Homo sapiens
  ref <308>: DATABASE ACCESSION NUMBER: NM_018326
  ref <309>: DATABASE ENTRY DATE: 2001-06-18
agagaggggtgcaagatcctgatttttcaggagttcaagcgacaatggcagcccaatacggcagtatgagcttcaaccccagcacaccaggggccagttatgggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtaccaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctctctatgttggcagataatctccccttgtagcttccactcacttattcttgcattcagagtcacaatgatcatcttacccatgtggtttttgagaaagaaagatcaattctttgtttgcagtgggtaatcttagagatggagatgattgtagaattattcctagatgagtgtcaatttatttaattccattgtcatataaggagtcaaattgtttcttatcatttgttcattgaagaacagagacctgtctggaaaatcgatctctacaaattcaattaaataatgatccccaaatgctgaaaaagtgaaatacagcaattcaacagataatagagcaatgtttagtatattcagctgtatctgtagaaactctttgacgaacctcaatttaaccaatttgatgaatacccagttctcttcttttctagagaaagatagttgcaacctcacctccctcactcaacactttgaatacttattgtttggcaggtcatccacacacttctgcccccactgcattgaattttttgcttatgttgtttataataaaacttttcaattatctc

SEQ ID NO: 1773 - DNA, 2499 bp, Homo sapiens
  ref <308>: DATABASE ACCESSION NUMBER: NM_018346
  ref <309>: DATABASE ENTRY DATE: 2001-06-18
gtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatattagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 1774 - DNA, 1720 bp, Homo sapiens
  ref <308>: DATABASE ACCESSION NUMBER: NM_018354
  ref <309>: DATABASE ENTRY DATE: 2001-06-18
gactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctgggtgagaggaatcctcatttttctctgccctctcactgtggcatcctaagaaaaaagttttgggttcctgcagcatgaaggagagctctgctcccagaatttgggagctccagatttcttccagggtgtggaggcatcaatatatcagtctgggaaaggggttcctgggccactccaggagctgagttgggtggaaggtgctgagagtgtgggtgggggccacttctgagcacccatgtggcacccactgctggtccctgtttgtggctgggcactcaggaaaatgtttttggtgctaagagtaaaaagccaaccaacaaacacatctcttttttctgtctattcactggaaagtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggctccaggaagacctacggctccattaacctgcgcatgagacagctcaatggggatgggggccaggccctggtggagaatgaagttgtccaggtctcagagactagccacaccctccagaggtcttaagaactagcccaccttatctggctgctttagctccagtgctacaaggtccaccccctgctcccgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgc

SEQ ID NO: 1775 - DNA, 1403 bp, Homo sapiens
  ref <308>: DATABASE ACCESSION NUMBER: NM_018366
  ref <309>: DATABASE ENTRY DATE: 2001-06-18
aaaggcgtgagcgcgcgtgcgtgcgtgtgcgggtgcgtgagcgtgagcgcgcggaggccggaagcgagcgctgcgcagtcgggtggtcgcgggccatggagggtagcttctcggatggcggagcgctgccggaggggctcgcggaagaggccgagccgcagggcgccgcctggagcggggacagtggcactgtttcccagagccacagcagcgcctcggggccgtgggaggacgagggcgcggaggacggcgcgccgggccgcgacctgccgctgcttcgccgcgccgctgcgggctacgccgcctgcctgctgcccggggccggggcgcggcccgaggtcgaggccctggacgcgagcctagaggacctgcttaccagagtggacgagttcgtgggcatgctggacatgcttcgcggcgactcgtcccacgtcgtcagcgagggcgtgccgcgcatccacgcgaaggccgccgagatgcggcgcatctacagcaggatcgaccggctggaggccttcgtgaggatggtggggggccgcgtggccaggatggaggagcaggtcaccaaggccgaggccgagctgggcaccttccccagggcgttcaagaagctcctgcacacgatgaacgtgccctcgctctttagcaagtctgctccctcgaggccacagcaagccggctacgaagcccccgtcctgtttcggaccgaagactacttcccttgttgcagtgaaaggcctcagctctgacggcctgaccactgcggcaagaggaccccagctggggtgcttacctccagtatgaagtgaattgcaaatcctgcttatggacatatatgatgttggagtgtgggattttaaagtttactttctacaaactctccgtagtatattcatgattcagtgtagaatgtatagactttatgtcttccaagtttaaaaaaagagacagggtcttggtatgttgcccagactgttcggaaactcctgggctcaagtgatccttccacctcagcctccccagtagctgggactacggggtcgccactgcacccagcctgtgtcttccagctctaatcagaaagctgcttgtcgagggcatggggaatcaaactgaatgaacttttctctgcactgtggcaaaactgttatttttatggattttactaaatggcgttaccttttcaagatttatatgtttgtataatcataagaaaattgagccattaaagccttgttattcaatcctaatagtcagttttctagaacctacttttagggtaaatggtacattatttaatattatattgaacctcctatagcgtggattgtagaccaaaggaaatggtacaatttctgagaatatatgttgattttttgtgactaattccaaagttgtatttg

SEQ ID NO: 1776 - DNA, 2835 bp, Homo sapiens
  ref <308>: DATABASE ACCESSION NUMBER: NM_018370
  ref <309>: DATABASE ENTRY DATE: 2001-06-18
gtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagcgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagaccctgtctcaaaaataaataaataaataaatgaataaagagaatgctaatcatttctgggttcactgcgactcactgtagtgctggggatcccccttgtaacactggaactgaaaggcagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgt

SEQ ID NO: 1777 - DNA, 1354 bp, Homo sapiens
  ref <308>: DATABASE ACCESSION NUMBER: NM_018373
  ref <309>: DATABASE ENTRY DATE: 2001-06-18
gggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggcaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacctttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaacctcatctctattt

SEQ ID NO: 1778 - DNA, 1891 bp, Homo sapiens
  ref <308>: DATABASE ACCESSION NUMBER: NM_018379
  ref <309>: DATABASE ENTRY DATE: 2001-06-18
tgaaaaccagcttgtagttagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgctgagcagttcccggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagacattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggc

SEQ ID NO: 1779 - DNA, 1812 bp, Homo sapiens
  ref <308>: DATABASE ACCESSION NUMBER: NM_018384
  ref <309>: DATABASE ENTRY DATE: 2001-06-18
gttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctgaagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctggaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccacatt

SEQ ID NO: 1780 - DNA, 1432 bp, Homo sapiens
  ref <308>: DATABASE ACCESSION NUMBER: NM_018389
  ref <309>: DATABASE ENTRY DATE: 2001-06-18
gcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgaccttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgcc

SEQ ID NO: 1781 - DNA, 2087 bp, Homo sapiens
  ref <308>: DATABASE ACCESSION NUMBER: NM_018390
  ref <309>: DATABASE ENTRY DATE: 2001-06-18
gttttttaggaagagtgtcccgcagagacccggcgggagctgccaggagctctgggattccagcggctggaagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttctcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaaatggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccaaattcatacagatcgtttaaataaatgaacatcattaaagtc

SEQ ID NO: 1782 - DNA, 3224 bp, Homo sapiens
  ref <308>: DATABASE ACCESSION NUMBER: NM_018401
  ref <309>: DATABASE ENTRY DATE: 2001-06-18
gtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctgatctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttc

SEQ ID NO: 1783 - DNA, 1704 bp, Homo sapiens
  ref <308>: DATABASE ACCESSION NUMBER: NM_018410
  ref <309>: DATABASE ENTRY DATE: 2001-06-18
atgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatctgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaaaaaaaaaaaaaaaaaaaa

SEQ ID NO: 1784 - DNA, 2886 bp, Homo sapiens
  ref <308>: DATABASE ACCESSION NUMBER: NM_018422
  ref <309>: DATABASE ENTRY DATE: 2001-06-18
tgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagcatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaaaaaaaaaaaaaaaaaaa

SEQ ID NO: 1785 - DNA, 3683 bp, Homo sapiens
  ref <308>: DATABASE ACCESSION NUMBER: NM_018439
  ref <309>: DATABASE ENTRY DATE: 2001-06-18
cctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattattttttttttatgcatgattttgtatatatggttatttttctttccataaaaatggtattaaactgtatatactgttttgtagcctacatatttcatatagaagtatattgttaacattttccatgtcaataaatattctatggctttct

SEQ ID NO: 1786 - DNA, 703 bp, Homo sapiens
  ref <308>: DATABASE ACCESSION NUMBER: NM_018454
  ref <309>: DATABASE ENTRY DATE: 2001-06-18
agtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctgggaaaaaataaaagaactgcaatcactactccaaactttaagaagcttcatgaagctcattttaaggaaatggagtccattgatcaatatattgaggagaaaaaaaaa

SEQ ID NO: 1787 - DNA, 1005 bp, Homo sapiens
  ref <308>: DATABASE ACCESSION NUMBER: NM_018455
  ref <309>: DATABASE ENTRY DATE: 2001-06-18
aatttcggcacgggggggaggcacagtgagtccactggggcacggcagcgtctaagccacaagccgactgacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggacttggaggcggcgggaactgcaattggtggctttgaagggcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactgggaaaatctacctccgacaagaggagatcattttagatattaccgaaatgaagaaagcttgcaattagtgaacatgaaaggaaaataaaaattcctcacagtcaaaaaaaaaaaaaaa

SEQ ID NO: 1788 - DNA, 927 bp, Homo sapiens
  ref <308>: DATABASE ACCESSION NUMBER: NM_018465
  ref <309>: DATABASE ENTRY DATE: 2001-06-18
ggcagcgggcgaaaggagccggggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcggattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaaaaaaaaaaa

SEQ ID NO: 1789 - DNA, 2140 bp, Homo sapiens
  ref <308>: DATABASE ACCESSION NUMBER: NM_018471
  ref <309>: DATABASE ENTRY DATE: 2001-06-18
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcaggccagaacccctgacggtattcagctgcgcgtaagtctggccggtgccatctgtctccgcaatgccccccaagaaacaggctcaggccgggggcagcaaaaaggcggacgaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagatttgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaaccggaaaatggagccattgatgctgttcctgttgatgaaaatcttttccactggagaggatttggatgaactagaagaagaattaaataccttgatttagaagaatgccccaaccctcgctgaaaaaattaagtcagccagcacgagttgaaattgactacattaatttcctttccacctagaatcaacaggatgtttatttcctatgctgattctggaggagttacctcctgcaaaaaaggcatcttgtccctacatcttctcttctgactttggctacatctcatagtaagttcagagtagttcatgataaattgaaaatataatggtcattgcagaaaatgattgatgttgtactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaaaaaaaaaaaaaaaaa

SEQ ID NO: 1790 - DNA, 1510 bp, Homo sapiens
  ref <308>: DATABASE ACCESSION NUMBER: NM_018478
  ref <309>: DATABASE ENTRY DATE: 2001-06-18
cgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcggcacgaggcctcttcctcgttcccggctcccagggcccgtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtggctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacaaaaaaaaaaaaaaaaaaaaaaaaa

SEQ ID NO: 1791 - DNA, 1402 bp, Homo sapiens
  ref <308>: DATABASE ACCESSION NUMBER: NM_018479
  ref <309>: DATABASE ENTRY DATE: 2001-06-18
ggcacgagcggcacgagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaaatcaccataggaatctcccagaggagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagttaaaaaaaaaattctttaaggctactattaatatgcagacttacttttaatcatttgaaatctgaactcatttacctcatttcttgccaattactcccttgggtatttactgcgtaattggaacatttactaaaataacacttttggcttaaaaaaaaaaaaaaaaaaaaaaaaaaaaaaaaa

SEQ ID NO: 1792 - DNA, 2341 bp, Homo sapiens
  ref <308>: DATABASE ACCESSION NUMBER: NM_018509
  ref <309>: DATABASE ENTRY DATE: 2001-06-18
agtgtaagcagtgtgcaaacaaggtgttacagcacatgaaggccgtgcaggcagatcaggagcgggagaggcagcggcggctggaagtagaacgtgaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtccttcagaccgactctcagcagtgagcttgttcccagcacctgctgcctcccagccttggagtttggattcctatggaattgggttctgctggacacaacctctttttagcatcagacctacctgccatcatcaaatggctgcagattggtacatgagacctcctctttgtaggacttcttcattccttagtcagggttccctgaaggaatgaggagaaatgggaggtggcgggggggcgtggggggcagttacctgcatgcctaaaggagtaggcttgggggtggggagagagaaaacatagccttttctagttgttatataaagctgtgtaaaggcaaggctcgtttctactaaatggtcagctgtcactacatttatacttttgtatgccacaaaccctttcattcctccctgggaatcagggtagatcaggaggaactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacaaacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattggaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtggacaaaaaaaaaaaaaaaaaaaaaaaaaaaaaaaaaaaaaaaaaaaaaaaaaaaaaaaaaaaaaaaaaaaaaaaa

SEQ ID NO: 1793 - DNA, 1159 bp, Homo sapiens
  ref <308>: DATABASE ACCESSION NUMBER: NM_018529
  ref <309>: DATABASE ENTRY DATE: 2001-06-18
gttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1794 - DNA, 1735 bp, Homo sapiens
  ref <308>: DATABASE ACCESSION NUMBER: NM_018556
  ref <309>: DATABASE ENTRY DATE: 2001-06-18
aagcatgatgggttttactagaacgtttcagtgtcactaagtcacagaagaggaggacaagaagaggaattatggcagggaccagctttatcacagtggtgtgcctggtttggcagggtgctcacaacttgtttgtgggatgtggaggtatcagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgagaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgagttccacccaccttggaggttactcaacagcccatgagggcggggaaccaggtaaacgtcacctgccaggtgaggaagttctacccccagagcctacagctgacctggttggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctggaggtcacagtccaccagaaggaccagagctcagatgctacccctggcccggcatcatctcttactgcgctgctcctcatagctgtcctcctgggccccatctatgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggggccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttccaaa

SEQ ID NO: 1795 - DNA, 1688 bp, Homo sapiens
  ref <308>: DATABASE ACCESSION NUMBER: NM_018569
  ref <309>: DATABASE ENTRY DATE: 2001-06-18
tgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaaaaaaa

SEQ ID NO: 1796 - DNA, 1321 bp, Homo sapiens
  ref <308>: DATABASE ACCESSION NUMBER: NM_018584
  ref <309>: DATABASE ENTRY DATE: 2001-06-18
ccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcgtgtgtttctttgttgctgcaagctatctgcccaagttaatgcaaatggacacattttttatgtcagaaaaacacacacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacac

SEQ ID NO: 1797 - DNA, 1844 bp, Homo sapiens
  ref <308>: DATABASE ACCESSION NUMBER: NM_018653
  ref <309>: DATABASE ENTRY DATE: 2001-06-18
cgggcaggtggggaacctccctgaagagtgccctggtcacagcacccttgaagacagccattggccatggggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccgtcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaaaaaaaaaa

SEQ ID NO: 1798 - DNA, 2068 bp, Homo sapiens
  ref <308>: DATABASE ACCESSION NUMBER: NM_018660
  ref <309>: DATABASE ENTRY DATE: 2001-06-18
ctgcacagggagtttgtcttgtgcaaacaatttccaaggcagcgttttcttccctgcctgggagtgcagggctcagcgccttcactttggaactgactcagagacctaaagaagcccacctggccagcgggaaggggggccgccgccgcctcccggttttgggcagccctggccagctccctgtggccttggaggacttccaccgggcaggcgttcccatgatgccaggctaccaggcgcgggggattcctgcaggccggcgctgcttttcttagaaccccctttctagaaaagtacacctggaggttttgcttcaaagagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcgtgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaa

SEQ ID NO: 1799 - DNA, 753 bp, Homo sapiens
  ref <308>: DATABASE ACCESSION NUMBER: NM_018683
  ref <309>: DATABASE ENTRY DATE: 2001-06-18
agcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgtcccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtg

SEQ ID NO: 1800 - DNA, 4050 bp, Homo sapiens
  ref <308>: DATABASE ACCESSION NUMBER: NM_018685
  ref <309>: DATABASE ENTRY DATE: 2001-06-18
gctggaagccgagaggagaagacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccttctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgccgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctgtcctcaagtgctgatgatgcgtctttggttaatgcctcaatttccagctctgtgaaagctacttcttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattccagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaactgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaata

SEQ ID NO: 1801 - DNA, 1376 bp, Homo sapiens
  ref <308>: DATABASE ACCESSION NUMBER: NM_018686
  ref <309>: DATABASE ENTRY DATE: 2001-06-18
agaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgc

SEQ ID NO: 1802 - DNA, 6409 bp, Homo sapiens
  ref <308>: DATABASE ACCESSION NUMBER: NM_018695
  ref <309>: DATABASE ENTRY DATE: 2001-06-18
aaagatcttttttttttttttttctttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaagctgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaggttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattggcccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgtctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaaaaaaaaaaaaaaaaaaaaaa

SEQ ID NO: 1803 - DNA, 6839 bp, Homo sapiens
  ref <308>: DATABASE ACCESSION NUMBER: NM_018728
  ref <309>: DATABASE ENTRY DATE: 2001-06-18
gccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaacgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcctcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccgaaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgtgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagctggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattgggaatgtgatttaaggaagaaaacagacttttgctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcctggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaacaacctcagattgaaaaagcaacctaaattactttcgctctctaatcagcatttcaatgtatttatttttaaattttctcaaaaagtaactaaaaaattgtgtcggaccctacttttgagaaatttacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcatttcaatacattgtacatgaaaaaatgaaaagtagaactttgtaatactttaatcaataaaattaattaccaaaaaaaaaaaaaaaaaa

SEQ ID NO: 1804 - DNA, 1104 bp, Homo sapiens; identical to SEQ ID NO: 153
  ref <308>: DATABASE ACCESSION NUMBER: NM_018840
  ref <309>: DATABASE ENTRY DATE: 2001-06-18

SEQ ID NO: 1805 - DNA, 2120 bp, Homo sapiens
  ref <308>: DATABASE ACCESSION NUMBER: NM_018842
  ref <309>: DATABASE ENTRY DATE: 2001-06-18
ctcctctcctggcccttctacgcctcccctgttccttctcctccccgtcccttctcctcttccctgaccctcagagctctggagaccaccccccatcccctgaccagctacacattttacaactagtgcacttaagttggggaggggtctgttgtgcgtcggtggggcccacgtcctcctcacaacttcttggaatcagtgacccgtgctgtcctggctgccgggcttaagccctccgggaccaaagacacaagctcgagtttcctctaagaaaagaaagcgcccaagaatgtgggggtgaaactcccctgtaattaggatcgccagaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatggtaatttaacttaaaatggtttaagtgtagagcttccaggagatgggaggaaacccccaccctcccctcccaacccacggccaggagcctggtaggagtgccttaaggacgcctttgcctggcccctttattacagcccaacacggtaggcacctcggcgggaatctcccttcc

SEQ ID NO: 1806 - DNA, 1188 bp, Homo sapiens
  ref <308>: DATABASE ACCESSION NUMBER: NM_018950
  ref <309>: DATABASE ENTRY DATE: 2001-06-18
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtcactgacagtgcccagggctctggggtgtctctcacagctaataaagtgtgagacagcttccttgtgtgggactgagaagcaagatatcaatgtagcagaattgcacttgtgcctcacgaacatacataaattttaaaaataaagaataaa

SEQ ID NO: 1807 - DNA, 3033 bp, Homo sapiens
  ref <308>: DATABASE ACCESSION NUMBER: NM_018988
  ref <309>: DATABASE ENTRY DATE: 2001-06-18
gagcgaacatggcagcagaatgaggaggctggcgccgggtcgtggccgccgctgccgcgctgcagctcgggatcccagtccggcgcgctccgggccgcatccttagccggcctcctggcggccgcgggattatttcattcccaacggagagctagggagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctaggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggattcccactgctggcaggagaaggcccattttcacagtccacagaagcgtgttaggctggggctgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttcctttaaaaaaaaaaaaaaaaaaaaaaaaaaaaaaaaaaaaaa

SEQ ID NO: 1808 - DNA, 2203 bp, Homo sapiens
  ref <308>: DATABASE ACCESSION NUMBER: NM_019000
  ref <309>: DATABASE ENTRY DATE: 2001-06-18
ctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagctcgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacctgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaaaaaaaaaaaaaaaa

SEQ ID NO: 1809 - DNA, 1483 bp, Homo sapiens
  ref <308>: DATABASE ACCESSION NUMBER: NM_019013
  ref <309>: DATABASE ENTRY DATE: 2001-06-18
cttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagaaccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgtgcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttg

SEQ ID NO: 1810 - DNA, 2291 bp, Homo sapiens
  ref <308>: DATABASE ACCESSION NUMBER: NM_019025
  ref <309>: DATABASE ENTRY DATE: 2001-06-18
ctttctgtgctgatcttggaggcagagtggctgcctgcattcattccacggtccattccacagcttgttccaaagacagtctgctcatgatgtagcttctgcacttgacaaactattttcatgcacgaggcccttgaaaatgttgacagtcttgtgacatccatggagggccttatttgacggtcacaaaggagcggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgccaaaaaaaaaaaaaaaaaaaaaaaaaaaaaaaaaaaaaaaaaaaaaaaaaaaaaaaaaaaaaaaaaacaaaaaaaaaaaaaaaaagc

SEQ ID NO: 1811 - DNA, 4020 bp, Homo sapiens
  ref <308>: DATABASE ACCESSION NUMBER: NM_019027
  ref <309>: DATABASE ENTRY DATE: 2001-06-18
gtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcacctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctccttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttgaatgacataaaataattgtgcaatgttcctgatgatgtaccccacagctgcattcaaactcaaatctgtgggaatgagtgactcgaccaaatgtaattcggatcagatcctcatcccctgactgtgtgaaaaaagtactctccttctagtgaaggattgtcacagagtttcactggatgaaactatgacccagtattcttactgtattttacatgtgcctgtaaattattttgccgaaataagaagaagaagaggaagaaagaacagtagaaaaaaaaaataaaaaaaaa

SEQ ID NO: 1812 - DNA, 1143 bp, Homo sapiens
  ref <308>: DATABASE ACCESSION NUMBER: NM_019041
  ref <309>: DATABASE ENTRY DATE: 2001-06-18
atgcggtcccgggttctgtggggcgctgcccggtggctctggccccgccgggccgttggcccagcccgccggcccctgagctccggtagcccgccgctggaggagctgttcacccggggcgggcccttgcggaccttcctcgagcgccaggcggggtctgaagcccatttgaaggtcaggaggcccgagttgctggcggtgatcaaactgctgaacgagaaggagcgggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaa

SEQ ID NO: 1813 - DNA, 1606 bp, Homo sapiens
  ref <308>: DATABASE ACCESSION NUMBER: NM_019044
  ref <309>: DATABASE ENTRY DATE: 2001-06-18
tataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaaccctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctg

SEQ ID NO: 1814 - DNA, 2035 bp, Homo sapiens
  ref <308>: DATABASE ACCESSION NUMBER: NM_019049
  ref <309>: DATABASE ENTRY DATE: 2001-06-18
attaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgagagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtttgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgacaaaaaaaaaaaaaaaaa

SEQ ID NO: 1815 - DNA, 1663 bp, Homo sapiens
  ref <308>: DATABASE ACCESSION NUMBER: NM_019063
  ref <309>: DATABASE ENTRY DATE: 2001-06-18
atcgagtcggccttgttgggtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactcgacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacag

SEQ ID NO: 1816 - DNA, 3361 bp, Homo sapiens
  ref <308>: DATABASE ACCESSION NUMBER: NM_019084
  ref <309>: DATABASE ENTRY DATE: 2001-06-18
ttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatttttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgggggaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtttgggttttgttttgtttaatttattgattagtctttaaagtaggcttttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagt

SEQ ID NO: 1817 - DNA, 507 bp, Homo sapiens
  ref <308>: DATABASE ACCESSION NUMBER: NM_019554
  ref <309>: DATABASE ENTRY DATE: 2001-06-18
ggtgcttctgagatgtgggcttgcacacgctgttgctatagtacgtgtgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 1818 - DNA, 1510 bp, Homo sapiens
  Modified_base 1 ... 1510: n = a,c,g, or t
  ref <308>: DATABASE ACCESSION NUMBER: NM_019845
  ref <309>: DATABASE ENTRY DATE: 2001-06-18
gcgagcgccgggaacgagcaccaccagggcttggcagcggacggctttagaagagcctagctgctgcgcgcgtcggagaggctcctgggaaactcccacggcccagggactttcgaaagcagagngnggagccctcgancgcgctagtctgcgagtgagcgctcagcccggcacctgttcctccagcgccgccgccttcccacccctcggacccgcgccgctcgcgcgncgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttgttctcacccgcaggtgggccaagctctgggggcaggtggagagggcgggcaggggagagacccagcggcactgatcgccttgtgaccggaagagtgacctgttaaaagccacgcagcagactcatggggtctcacaaatccgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggaagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgttaaaaaaaaaaaaaaaaaaaaaaaaaaaaaaaaaaaaa

SEQ ID NO: 1819 - DNA, 2516 bp, Homo sapiens
  ref <308>: DATABASE ACCESSION NUMBER: NM_019858
  ref <309>: DATABASE ENTRY DATE: 2001-06-18
gagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatgg

SEQ ID NO: 1820 - DNA, 1350 bp, Homo sapiens
  ref <308>: DATABASE ACCESSION NUMBER: NM_020130
  ref <309>: DATABASE ENTRY DATE: 2001-06-18
agactctctggaaagcctgggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactctttcgtccctgcaggaaaggattgatgctgatagaagagcctggacagatgtaatgagaactaaagaaaacagatggctggagatgacatttattcaggggcactttgcaggccctaggacttaaatcgaaagttgactttttttttttttttaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaagaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtgaaaaaaaaaaaaaaaaaaaaaaa

SEQ ID NO: 1821 - DNA, 1774 bp, Homo sapiens
  ref <308>: DATABASE ACCESSION NUMBER: NM_020133
  ref <309>: DATABASE ENTRY DATE: 2001-06-18
tgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcaaaaaaaaaaaaaaa

SEQ ID NO: 1822 - DNA, 1194 bp, Homo sapiens
  ref <308>: DATABASE ACCESSION NUMBER: NM_020143
  ref <309>: DATABASE ENTRY DATE: 2001-06-18
agcctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaa

SEQ ID NO: 1823 - DNA, 761 bp, Homo sapiens
  ref <308>: DATABASE ACCESSION NUMBER: NM_020150
  ref <309>: DATABASE ENTRY DATE: 2001-06-18
ctggcggtcccgggtgctgctggttagtgtgctctgagggagggtccgagccagccgctgttttgccggagagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctaaaaaaaaaaaaaaaa

SEQ ID NO: 1824 - DNA, 4700 bp, Homo sapiens
  ref <308>: DATABASE ACCESSION NUMBER: NM_020163
  ref <309>: DATABASE ENTRY DATE: 2001-06-18
atggccccctcggcctgggccatttgctggctgctagggggcctcctgctccatgggggtagctctggccccagccccggccccagtgtgccccgcctgcggctctcctaccgagacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccctcgccctggcgtgtgccccagcaagatgaccgcacagccaggacggccttttggcagcaccaaggactacccagatgaggtgctgcagtttgcccgagcccaccccctcatgttctggcctgtgcggcctcgacatggccgccctgtccttgtcaagacccacctggcccagcagctacaccagatcgtggtggaccgcgtggaggcagaggatgggacctacgatgtcattttcctggggactgactcagggtctgtgctcaaagtcatcgctctccaggcagggggctcagctgaacctgaggaagtggttctggaggagctccaggtgtttaaggtgccaacacctatcaccgaaatggagatctctgtcaaaaggcaaatgctatacgtgggctctcggctgggtgtggcccagctgcggctgcaccaatgtgagacttacggcactgcctgtgcagagtgctgcctggcccgggacccatactgtgcctgggatggtgcctcctgtacccactaccgccccagccttggcaagcgccggttccgccggcaggacatccggcacggcaaccctgccctgcagtgcctgggccagagccaggaagaagaggcagtgggacttgtggcagccaccatggtctacggcacggagcacaatagcaccttcctggagtgcctgcccaagtctccccaggctgctgtgcgctggctcttgcagaggccaggggatgaggggcctgaccaggtgaagacggacgagcgagtcttgcacacggagcgggggctgctgttccgcaggcttagccgtttcgatgcgggcacctacacctgcaccactctggagcatggcttctcccagactgtggtccgcctggctctggtggtgattgtggcctcacagctggacaacctgttccctccggagccaaagccagaggagcccccagcccggggaggcctggcttccaccccacccaaggcctggtacaaggacatcctgcagctcattggcttcgccaacctgccccgggtggatgagtactgtgagcgcgtgtggtgcaggggcaccacggaatgctcaggctgcttccggagccggagccggggcaagcaggccaggggcaagagctgggcagggctggagctaggcaagaagatgaagagccgggtgcatgccgagcacaatcggacgccccgggaggtggaggccacgtagaagggggcagaggaggggtggtcaggatgggctggggggcccactagcagcccccagcatctcccacccacccagctagggcagaggggtcaggatgtctgtttgcctcttagagacaggtgtctctgcccccacaccgctactggggtctaatggaggggctgggttcttgaagcctgttccctgcccttctctgtgctcttagacccagctggagccagcaccctctggctgctggcagccccaagggatctgccatttgttctcagagatggcctggcttccgcaacacatttccgggtgtgcccagaggcaagagggttgggtggttctttcccagcctacagaacaatggccattctgagtgaccctcagagtgggtgtgtgggtgcgtctagggggtatcccggtagggggcctgcagggagccagagggtggaaatggcctctaagctagcaccccgtaagaagagcctacctgaccgacttggggagggaacacagaggtgttgggaaggtggagcaacaatgcacctcccctcctgtcgcgccgtgatatcttggtggctccctgccactgcccaccgcctcttctccatctgagaatcacggagaggtgtagataatctagaggcatagactgctagagcccccagggatctggggtggtcagggctcaggcttcactttgtaaaccaggtgggggcatctcacagcctgacttcccttccccaggccagggttgctgggatgcctgcccctcctgagaggaccccctccccattgtcaggctctccatgtccacgagcggggaggggtgggttctggggcattgttgtcccttgtgtctgtggactagagatagggtgggggagctggggaagggtgcaggcgggaagagtgggctgtctttcccagggtgatgcaagcatgccgcagccctggaggctgggaatgtggaggctctgtgagccctgcagccctcagaatcagggccagggatgcagaagattgagaggatatggagatggatagagggcaggagacccttaggatagattgtgggacccaggcaggaacaggtgtccacaagaactcaggatggcatcagttagctcagaagccacctggaagacccagtgtttccatctctggaatctctgttttatgctaaatggatttaggaagactgtttttcttttaagggggaaacaaggtagagaaaaggacgaagaagtgtaagtcccgctgattctcgggggtaaggctcggatggcaaggacgcgttctgcctgggcatgtaggggaggtgtttttgccatcaccagtttctcaggctggggagcacagaggggaggaggaggactaaatgaaaagttgttcccagcctgcacatgaacacattcatgacacacaaaactggctggaaggagataagagcactgggtttgagattccctccattaaaacaaccaagacaaagaaaggaggggaaaaaaagataaaaagcaagccagggttccctgccctattgaaactcaaacccagactgccttgggttttatctttcccttacccctggcacctccagagaactgggacctgaaatagtccctccgttctcccctttgaccatgtaataaatgaaccagaagcactgagattaacctatcaacgccctgagaagccttccagcctgcggtgctgtctgctgggaggtcagctggtcaaggcagaggaggagaggaggaaaggatgggggctgaagagcagaagggaggggagacagaggggattaaagaggggaggagagagtgcagagctccaggaaagggtatcagagctgcagccagctctgccctctaccctagggaggccagaaagacacaaacagccctccgggcctttacgctggactctggcttggcaggctccaggcagggtcctctgggaagttactctagaaaacgaagggaggaggagcacaagatcctcagcaacgaacacctgcacttagaaaaagtggacagcttctgccaaccacaccctacccatggtactgtatgctattaactcctggaaacgccccgtaaatgcgagttgtttttgtatttgtgtgttgagatgggccttgtggtttctctgtactcagagcacatttcttgtaattactattgttatttttattgtcatgactgcccctgagctctggtgagaaaagctgaatttacaaggaaagggatgaagttaatatttgcatcacataattatatcattactgtgtatctgtgtattgtactaaatggactgatgctgcgcacatgagctgaaaatgaagagccctcccatcc

SEQ ID NO: 1825 - DNA, 2528 bp, Homo sapiens
  ref <308>: DATABASE ACCESSION NUMBER: NM_020166
  ref <309>: DATABASE ENTRY DATE: 2001-06-18
cccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 1826 - DNA, 1049 bp, Homo sapiens
  ref <308>: DATABASE ACCESSION NUMBER: NM_020169
  ref <309>: DATABASE ENTRY DATE: 2001-06-18
gggaaggagctgaggaagaagactgactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcaccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcaggagattattccctggcaaatgcaagttctctggcatccacaatacggcactaaagtaaaacataatagccgtctgccaaaggaagtacaactggaataaacaaaaaccctaacactggaagtgcaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcc

SEQ ID NO: 1827 - DNA, 953 bp, Homo sapiens
  ref <308>: DATABASE ACCESSION NUMBER: NM_020179
  ref <309>: DATABASE ENTRY DATE: 2001-06-18
agcggcgcaagcggcggcggccactgccacgtattcccggcagtggtggcgggggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaaggcgcgggagggggacgcaaacaaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaaaaa

SEQ ID NO: 1828 - DNA, 4561 bp, Homo sapiens
  ref <308>: DATABASE ACCESSION NUMBER: NM_020184
  ref <309>: DATABASE ENTRY DATE: 2001-06-18
catgaggctggcgagctgcaacaagtcgtgtgggacgaacccggatggcatcatcttcgtgtccgagggcagcaccgtgaacctgaggctgtacggctacagcctgggcaacatctccagcaatctgatctccttcaccgaggtggacgatgccgagaccctccacaagtccaccagcttgcctcgagctcaccaaggacctggtcgtccagcagcttggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacatcatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggtgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaaaaaaaaaaaaaaaaaaa

SEQ ID NO: 1829 - DNA, 957 bp, Homo sapiens
  ref <308>: DATABASE ACCESSION NUMBER: NM_020186
  ref <309>: DATABASE ENTRY DATE: 2001-06-18
gcgcgtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaaaaa

SEQ ID NO: 1830 - DNA, 716 bp, Homo sapiens
  ref <308>: DATABASE ACCESSION NUMBER: NM_020188
  ref <309>: DATABASE ENTRY DATE: 2001-06-18
acggtggagcggtggagggcgtcactgggtttcggcgtctggcaagcggttcagctgtctgctccctagcagccggccttcgggtcgggcgtctccgcggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataaaaaaaaaaaa

SEQ ID NO: 1831 - DNA, 676 bp, Homo sapiens
  ref <308>: DATABASE ACCESSION NUMBER: NM_020189
  ref <309>: DATABASE ENTRY DATE: 2001-06-18
aatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaaaaaaaaaaaaaaaaaaaaa

SEQ ID NO: 1832 - DNA, 1694 bp, Homo sapiens
  ref <308>: DATABASE ACCESSION NUMBER: NM_020197
  ref <309>: DATABASE ENTRY DATE: 2001-06-18
gcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagagttttaaaaatggaattattttttctttcatgcctcttgtaatgttctgaacaaacttgaatgatgaaagtattaaagagatatcagtaaaaaaaaaaaaaaaaaaaaaaaaaaaa

SEQ ID NO: 1833 - DNA, 2371 bp, Homo sapiens
  ref <308>: DATABASE ACCESSION NUMBER: NM_020199
  ref <309>: DATABASE ENTRY DATE: 2001-06-18
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaaggatcccaaacttgtaactaaattctgacatatctgttactgctgactcacattcattctccgccattcaaatactattttttatccacattttttttttgttccccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctaaaaaaaaaaaaaaaaaa

SEQ ID NO: 1834 - DNA, 3477 bp, Homo sapiens
  ref <308>: DATABASE ACCESSION NUMBER: NM_020215
  ref <309>: DATABASE ENTRY DATE: 2001-06-18
cttactgctttgtgaggttgtgagtggccaccactgaaggtctttgagaagaggccagacgctgctgtagccaggcctgtcttaagaggacttgtgcttccagggacccaggcaggatgatggcgcagctcttcctactccaagccaacgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggccggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcataggtggtgcggtccccggggattctggatgctggtcttttgaccgtggcggcagcctcgcgcctgcccggatggctccatccagacatttggcaaggctgtcatctgctcttgggtccctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctgccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacaactaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgagttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggactgctgggtagcagcctttgagcaaatctgcatcttctcttatttctgacctttttccacgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaatataggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaaaaaaaaaaaaaaaaaa

SEQ ID NO: 1835 - DNA, 1536 bp, Homo sapiens
  ref <308>: DATABASE ACCESSION NUMBER: NM_020244
  ref <309>: DATABASE ENTRY DATE: 2001-06-18
cggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggtttttttcctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataattttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttaaaaaaaaaaaaaaaaaaaaaaa

SEQ ID NO: 1836 - DNA, 3384 bp, Homo sapiens
  ref <308>: DATABASE ACCESSION NUMBER: NM_020347
  ref <309>: DATABASE ENTRY DATE: 2001-06-18
gcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgataatttgcttatgtcttataaaactcagcataagaaaaat

SEQ ID NO: 1837 - DNA, 1602 bp, Homo sapiens
  ref <308>: DATABASE ACCESSION NUMBER: NM_020365
  ref <309>: DATABASE ENTRY DATE: 2001-06-18
ggagatcgctgggagcggttgcgcgtgcggggagctgagttatagctgtgacttctgccctgccaggccgcacacagcggtctgacccggtttggtttgtaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggtaaaaaaaaaaaaaaaaaaaaaaaaaaaaaaa

SEQ ID NO: 1838 - DNA, 867 bp, Homo sapiens
  ref <308>: DATABASE ACCESSION NUMBER: NM_020386
  ref <309>: DATABASE ENTRY DATE: 2001-06-18
cgtttcagcgtggcggcgctggtgctggcgttggccctggaggacggccccgagtgatggctggcgcctgcctcccgggtgtctcccgggtacagatggagtcgtcccgcggccgccggcggcaaggtcggcagctgcgaggccaagagagaccccaggacacacacagctgcctcccggtgcgagaagaagaccccggcttgagagtgagatggcgtttaatgattgcttcagtttgaactaccctggcaacccctgcccaggggacttgatcgaagtgttccgtcctggctatcagcactgggccctgtacttgggtgatggttacgttatcaacatagcacctgtagatggcattcctgcgtcctttacaagcgccaagtctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtgaatacttattttcagtgcatcattactgttccagattcctatgatggatggcagactctttaataaattgcttactgatattatctt

SEQ ID NO: 1839 - DNA, 2110 bp, Homo sapiens
  ref <308>: DATABASE ACCESSION NUMBER: NM_020445
  ref <309>: DATABASE ENTRY DATE: 2001-06-18
ggcacgaggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcacctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacatctggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgt

SEQ ID NO: 1840 - DNA, 3879 bp, Homo sapiens
  ref <308>: DATABASE ACCESSION NUMBER: NM_020639
  ref <309>: DATABASE ENTRY DATE: 2001-06-18
gcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagcttctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaagaaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacactcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatatatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaaaaaaaaaaa

SEQ ID NO: 1841 - DNA, 1816 bp, Homo sapiens
  ref <308>: DATABASE ACCESSION NUMBER: NM_020659
  ref <309>: DATABASE ENTRY DATE: 2001-06-18
ccggcgtccgccccgctgccccctcccccgggggccatgggggcgcccccgggctaccggccctcagcttgggtgcatctcctccaccaactgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtggggacatgagtccccctgctgcccctgccacatcccagtgggctctgaccccctgatctcaactcgtggcactaacttggaaaagggttgatttaaaataaaagggaagactattttacaagc

SEQ ID NO: 1842 - DNA, 675 bp, Homo sapiens
  ref <308>: DATABASE ACCESSION NUMBER: NM_020675
  ref <309>: DATABASE ENTRY DATE: 2001-06-18
atggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaa

SEQ ID NO: 1843 - DNA, 351 bp, Homo sapiens
  ref <308>: DATABASE ACCESSION NUMBER: NM_020686
  ref <309>: DATABASE ENTRY DATE: 2001-06-18
atggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaa

SEQ ID NO: 1844 - DNA, 3737 bp, Homo sapiens
  ref <308>: DATABASE ACCESSION NUMBER: NM_020974
  ref <309>: DATABASE ENTRY DATE: 2001-06-18
ggcgtccgcgcacacctccccgcgccgccgccgccaccgcccgcactccgccgcctctgcccgcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacat

SEQ ID NO: 1845 - DNA, 1536 bp, Homo sapiens
  ref <308>: DATABASE ACCESSION NUMBER: NM_020978
  ref <309>: DATABASE ENTRY DATE: 2001-06-18
atgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataa

SEQ ID NO: 1846 - DNA, 2110 bp, Homo sapiens
  ref <308>: DATABASE ACCESSION NUMBER: NM_020979
  ref <309>: DATABASE ENTRY DATE: 2001-06-18
ggatccaagctattgtcctgcccatggcttcccatctcaggacgctctctggccgctatcatcccagcagtggagttcagcccactactctgaaccagccgcaggtggctgctatgggactgaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgtcctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 1847 - DNA, 2948 bp, Homo sapiens
  ref <308>: DATABASE ACCESSION NUMBER: NM_020980
  ref <309>: DATABASE ENTRY DATE: 2001-06-18
aggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccaccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 1848 - DNA, 14770 bp, Homo sapiens
  ref <308>: DATABASE ACCESSION NUMBER: NM_020987
  ref <309>: DATABASE ENTRY DATE: 2001-06-18
gggacaccatcatttgggtttttaaaagcttcagcttctccagcatctttgcattgtgaatatcttcctgcttctagtcaaagctttctctctagtgattggaatgctgctgtaagcctattagaggtgcctgaggatatcaccttttacaaggaagccgtgtgtgcttgagaggatctttttaaatgcattatggctcatgcagcctcacaattaaagaaaaacagggatttagaaatcaatgctgaagaagagcctgagaaaaaaaggaaacaccgcaaacggtcccgggatcggaagaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgcaaagacgacacaaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatatcgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccacccccacatggtgaaaggagagggattagcagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgattgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatccttacggacaatgtcttcgccgataaaaactgtggtgtcacaatctccatacaatatccaggtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcacgagttgatgtcatttcatcagccaaaattacaatggcatcttctctctcatcacctgtgaagcagatgcctggacatgcagaggtagcattagtcaatggatctatttcccctctaaaatatgcatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgagggaggacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaacgactggtcctaaaccactttttcatgaagttcccatccctcctgttattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacccagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcttgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcacct

SEQ ID NO: 1849 - DNA, 609 bp, Homo sapiens
  ref <308>: DATABASE ACCESSION NUMBER: NM_021000
  ref <309>: DATABASE ENTRY DATE: 2001-06-18
atggctactctgatctatgttgataaggaaaacgaagaaccaggcatccttgtggctacaaaggatgggctgaagctggggtctggaccttcaatcaaagccttagatgggagatctcaagtttcaatatcatgttttggcaaaacattcgatgctcccacatccttacctaaagctaccagaaaggctttgggaactgtcaacagagctacagaaaagtcagtaaagaccaatggacccctcaaacaaaaacagccaagcttttctgccaaaaagatgactgagaagactgttaaagcaaaaaactctgttcctgcctcagatgatggctatccagaaatagaaaaattatttcccttcaatcctctaggcttcgagagttttgacctgcctgaagagcaccagattgcacatctccccttgagtgaagtgcctctcatgatacttgatgaggagagagagcttgaaaagctgtttcagctgggccccccttcacctttgaagatgccctctccaccatggaaatccaatctgttgcagtctcctttaagcattctgttgaccctggatgttgaattgccacctgtttgctgtgacatagatatttaa

SEQ ID NO: 1850 - DNA, 1281 bp, Homo sapiens; identical to SEQ ID NO: 112
  ref <308>: DATABASE ACCESSION NUMBER: NM_021004
  ref <309>: DATABASE ENTRY DATE: 2001-06-18

SEQ ID NO: 1851 - DNA, 876 bp, Homo sapiens
  ref <308>: DATABASE ACCESSION NUMBER: NM_021025
  ref <309>: DATABASE ENTRY DATE: 2001-06-18
atggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggccccggcgcgcccttcgaggacgcgggatcttacagtgtcaacctgagcctagcgcccgcaggcgtgatccgggtgccggcgcacaggccgctgcccggggccgtgccgccgcctctgcctagcgcgctgcccgctatgccctcggtgcccacggtctccagcctagggcgtctcaatttcccctggatggagagcagtcgccgctttgtgaaagaccgcttcacagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggcggcagacggcggaggagcgggaggcggacgggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctctctggtgtga

SEQ ID NO: 1852 - DNA, 381 bp, Homo sapiens
  ref <308>: DATABASE ACCESSION NUMBER: NM_021063
  ref <309>: DATABASE ENTRY DATE: 2001-06-18
atgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaa

SEQ ID NO: 1853 - DNA, 393 bp, Homo sapiens
  ref <308>: DATABASE ACCESSION NUMBER: NM_021065
  ref <309>: DATABASE ENTRY DATE: 2001-06-18
atgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaagggcaagtaa

SEQ ID NO: 1854 - DNA, 639 bp, Homo sapiens
  ref <308>: DATABASE ACCESSION NUMBER: NM_021077
  ref <309>: DATABASE ENTRY DATE: 2001-06-18
cgcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatcccattggggacagctccccacacctcccctgagggaccagcgactgcagctgagtcatgatctgctcggaatcctcctgctaaagaaggctctgggcgtgagcctcagccgccccgcaccccaaatccagtacaggaggctgctggtacaaatactgcagaaatgacaccaataataggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctt

SEQ ID NO: 1855 - DNA, 3162 bp, Homo sapiens
  ref <308>: DATABASE ACCESSION NUMBER: NM_021095
  ref <309>: DATABASE ENTRY DATE: 2001-06-18
gcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctaaaaaaaaaaaaaaaaaa

SEQ ID NO: 1856 - DNA, 1237 bp, Homo sapiens
  ref <308>: DATABASE ACCESSION NUMBER: NM_021101
  ref <309>: DATABASE ENTRY DATE: 2001-06-18
gaattcggcacgaggcctcgtgccggggagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctaaagtatgttattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagccagtaaaaaaaaaaaaaaaaaaaaa

SEQ ID NO: 1857 - DNA, 453 bp, Homo sapiens
  ref <308>: DATABASE ACCESSION NUMBER: NM_021103
  ref <309>: DATABASE ENTRY DATE: 2001-06-18
gcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggca

SEQ ID NO: 1858 - DNA, 384 bp, Homo sapiens
  ref <308>: DATABASE ACCESSION NUMBER: NM_021128
  ref <309>: DATABASE ENTRY DATE: 2001-06-18
acgagccgccgccatgatcatccctgtacgctgcttcacttgtggcaagatcgtcggcaacaagtgggaggcttacctggggctgctgcaggccgagtacaccgagggggacgcgctggatgccctgggcctgaagcgctactgctgccgccggatgctgctggcccacgtggacctgatcgagaagctgctcaattatgcacccctggagaagtgaccacgctgaaacccacccacccgctgtgctgaccatgggccctgagcgtcctaccccgaattcacgaggctgaggcatccgggagctggcgtaatgcctggccgcagtgtgtgtgtatcccataccccactctggaaggaaccatccagtaaaggtctttcagaacc

SEQ ID NO: 1859 - DNA, 1224 bp, Homo sapiens
  ref <308>: DATABASE ACCESSION NUMBER: NM_021147
  ref <309>: DATABASE ENTRY DATE: 2001-06-18
gtttccgggttgagtctggactcctaccgaactcgggcaagttatttaacacccctgagcttctttcttcatctgcaaaatggaacccctcccttcctttgaattgctgagcccattacgcgaggtaacgttgtacgacgctctctgcacagcgccaggtcccaatcccggtgttccggctcagcaggccaggagcgtttccagtttccattgcgtttctctttctgaactcttcttgcccctctcctgggaagctccccgattcttcttggcccttccttcccttccacagctccctctccaccctaagcccagcgggcccgcctccccccctccttcccggcaggtgacggcggaatcccgctgtaagctgctcagctggctgatcccggtgcaccgccaattcggcctctccttcgagtcgctgtgcctgacggtgaacactctggaccgcttcctcaccaccacgccggtgctgcagactgcttccagctgcttggggtcacctccttgctcatcgcttgcaaacaggtggaggtgcacccgccgcgcgtggaagcagcttctggccctctgctgcggcgccttctcccggcagcagctctgcaacctcgagtgcatccgtgctgcacaagctgcacttcaccctgggtgcgccaccattagcttcttcctgacatttcagcacctcctgagcgcagctaggcctccgaagctctggaagcgcaagccctggcgccggggggtggcagagctgagtctggccgactatgccttcaccagctactccccttccctcctggcgatctgctgcctggcgctggcggaccgcatgctgcgtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtct

SEQ ID NO: 1860 - DNA, 3152 bp, Homo sapiens; identical to SEQ ID NO: 138
  ref <308>: DATABASE ACCESSION NUMBER: NM_021151
  ref <309>: DATABASE ENTRY DATE: 2001-06-18

SEQ ID NO: 1861 - DNA, 1111 bp, Homo sapiens; identical to SEQ ID NO: 205
  ref <308>: DATABASE ACCESSION NUMBER: NM_021181
  ref <309>: DATABASE ENTRY DATE: 2001-06-18

SEQ ID NO: 1862 - DNA, 3054 bp, Homo sapiens
  ref <308>: DATABASE ACCESSION NUMBER: NM_021190
  ref <309>: DATABASE ENTRY DATE: 2001-06-18
tcggcacgagcgtggctcggttcttgtgagcgaagctttgtccggttcggcaatggacggaatcgtcactgaagttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctggcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatcccttagtttgtaattaagatttggaatatggttgtggatttctgagcatgtgcagactggtctagctagttccaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaaaaaaaaaaaaaaaaa

SEQ ID NO: 1863 - DNA, 2655 bp, Homo sapiens
  ref <308>: DATABASE ACCESSION NUMBER: NM_021198
  ref <309>: DATABASE ENTRY DATE: 2001-06-18
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggagccatccctaagcagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcacgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagacccctaaaaaaaaaaaaaaaaaa

SEQ ID NO: 1864 - DNA, 2402 bp, Homo sapiens
  ref <308>: DATABASE ACCESSION NUMBER: NM_021200
  ref <309>: DATABASE ENTRY DATE: 2001-06-18
aagagaggaaggcttaaagagccagactgcgcagccaggactggggtatgggcgctgtcctgcaggccaaagaatgaagatgtagccccgcccccaacctaggaggaggaccagcccggttcctgtcctgcccccgcaacctcgccccgattccactccgggaacctcggcgatgctgagccaagaccacttctgaatcagggatgacttgtctagtgaacgtagggtcagagccatcagttggaaaggctgggaggagcctggagaaagaggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttatagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggttctagcagtaaaaaaaaaaaaaaaaaaaaaaaaaaaa

SEQ ID NO: 1865 - DNA, 660 bp, Homo sapiens; identical to SEQ ID NO: 168
  ref <308>: DATABASE ACCESSION NUMBER: NM_021203
  ref <309>: DATABASE ENTRY DATE: 2001-06-18

SEQ ID NO: 1866 - DNA, 3097 bp, Homo sapiens; identical to SEQ ID NO: 341
  ref <308>: DATABASE ACCESSION NUMBER: NM_021238
  ref <309>: DATABASE ENTRY DATE: 2001-06-18

SEQ ID NO: 1867 - DNA, 1956 bp, Homo sapiens; identical to SEQ ID NO: 203
  ref <308>: DATABASE ACCESSION NUMBER: NM_021242
  ref <309>: DATABASE ENTRY DATE: 2001-06-18

SEQ ID NO: 1868 - DNA, 408 bp, Homo sapiens
  ref <308>: DATABASE ACCESSION NUMBER: R70506
  ref <309>: DATABASE ENTRY DATE: 2001-06-18
tttttgtcgtttttggttttttttgagacagcgtcttagtctgtcgccaaggctggagtgcagtggcgcaatcaaagcttgctgcagccttgaactcctgggctcaagcaatcctcttacctcagcaactaggactacaggcacatgccaccacgcttggccttctaatttatttctgtgtcaacaaaataaaactcaggcctaggaatagcttggttcagaaatcacagagggacttagtattccattaatacaaatggaaacattaagttcatcatcagatgataaaaggaaaaaaaaaaacctgatactcatctcaaaagacggcggaaaagacatttggcataaatccaggtacctattattatttccaaatttaaaaacttcttcttttttaaggggtagggg

SEQ ID NO: 1869 - DNA, 895 bp, Homo sapiens
  ref <308>: DATABASE ACCESSION NUMBER: S40706
  ref <309>: DATABASE ENTRY DATE: 2001-06-18
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctcttcggacactgtcagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctat

SEQ ID NO: 1870 - DNA, 2574 bp, Homo sapiens
  ref <308>: DATABASE ACCESSION NUMBER: S53354
  ref <309>: DATABASE ENTRY DATE: 2001-06-18
cctggcgcagccgcagcagcgacgcgagcgaactcggccgggcccgggcgcgcgggggcgggacgcgcacgcggcgagggcggcgggtgagccgggggcggggacgggggcgggacgggggcgaagggggcggggacgggggcgcccgccggcctaacgggattaggagggcgcgccacccgcttccgctgcccgccggggaatcccccgggtggcgcccagggaagttcccgaacgggcgggcataaaagggcagccgcgccggcgccccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcatttattgctgagttatatgttcactgtccccctaatattagggagtaaaacggataccaagttgatttagtgtttttacctctgtcttggctttcatgttattaaacgtatgcatgtgaagaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaaa

SEQ ID NO: 1871 - DNA, 3068 bp, Homo sapiens
  ref <308>: DATABASE ACCESSION NUMBER: S59184
  ref <309>: DATABASE ENTRY DATE: 2001-06-18
aacggtatcgataagcttgatatcgaattccgcacccccggctcggggctgtgagcggctcggggccgggggtgggcggcggtgcggcgggcggccgacgctcctcttcggcggcggcggcggcggcggcccatgcgtggggcggcgcggctggggcggccgggccggagttgcctcccggggcccgcgctgagggccgccgccgcgcccgccctgctgcttgctcgttgcgctgttgccgctgctgccggcctgcgtgccgccgcccgtccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttaatctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcataatatgaaaaggattgaactggatgacagcattagtgccagcagtagttcccaagggctgtctcagccatccacccagacgactcagtatctgagagcagacacgcccaacaatgcaactcctatcaccagttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgaacagcttgtgggaactcatgactctgggccagactccctacacgttggacattgaccccttcgagatggcggcatacctgaaagatggttaccgaatagcccagccaatcacctgtcctgatgaattatttgctgtgatggcctgttgctgggccttagatccagaggagaggcccaggtttcagcagctggtacagtgcctaacagagtttcatgcagccctgggggcctacgtctgactcctctccaatcccacaccatcaggaagaaggtgcctgtcggggctcacttgaagcctgtcagggatgctttgtatatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagggccaactgctttttatttttttacttcatcaaggtgatgtaagtgactttgtttagacacagatatttggaattagcctatcttagtgccaactgctttttatttttttccttcatcaaggtgatgtaagtgactcacctttaaagtttttttagtgttattttttatcactactctgggaaatggtttgtcttcaagatgcaatacttttcttagataaggaaaaacagcataaaaagatacctggtctgccttgtacaagaaaaccgaatattagaggaagaaaatttaaagaaaagctagagaaaaaaaaaattttttaaaaaatacttattagaagcaaactgcccttgcatggaaaactgtttatttttttcagtgaaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggtaagatcccttttatgcacctagaatatgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattaaaaaaaaaa

SEQ ID NO: 1872 - DNA, 1682 bp, Homo sapiens
  ref <308>: DATABASE ACCESSION NUMBER: S62138
  ref <309>: DATABASE ENTRY DATE: 2001-06-18
atgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtgtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatg

SEQ ID NO: 1873 - DNA, 3505 bp, Homo sapiens
  ref <308>: DATABASE ACCESSION NUMBER: U09848
  ref <309>: DATABASE ENTRY DATE: 2001-06-18
aggaatgagggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcatttttttttttttgacatctttctgtggcaaacctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgagggtatgaaactttcattggtcccatcgttgtgcgcagggtgcaactggctacctagaagctgatggcaggagactgttcacacacaggagattgtgagctgtgtaagtagtcatcgccactcaagtaggacaagggtcctacccaaggctaggaccgcctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtgtcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatcctttagagcacatc

SEQ ID NO: 1874 - DNA, 6868 bp, Homo sapiens
  ref <308>: DATABASE ACCESSION NUMBER: U10991
  ref <309>: DATABASE ENTRY DATE: 2001-06-18
gaattccagagggccgcctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccagggctttccaaggaaagaggttttgagtcttcacactgtaaatggatttgtctctgatttcagcaccggtagtgtctcatctcccatcattacagcaccaaggacgaatcccctttcttcaggaccacctctaccttccatactctccatacaagccacccagactgttttcccatctctcttggctttttccagcaccaagccagaggtttatgcagctgctgtggaccattctgggttgccagcttcagctcccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccattgcaaggaaacatggacactgcctctggcctgttgtctacaacttacctcccccaggaaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgtagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctataaatagacctgattctttgtttccctcgtcaattaaacaaaggccaagaaagagagaagatgagagggaatggtggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgaggaatggagcttctctttttcttgggataatagatacatcaacttttacaagaaaatctctgtctcttcaacaatgatgtccagtgtgtgctgctgagtggtacaaaaggaaatagtacttgaaacctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtattctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgta

SEQ ID NO: 1875 - DNA, 2280 bp, Homo sapiens
  ref <308>: DATABASE ACCESSION NUMBER: U17077
  ref <309>: DATABASE ENTRY DATE: 2001-06-18
ccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttttgcaacctgataccttgaaaagcttctatgtgtctctccttttgttgcctggcagctgtctaggatgatcactgattactatttactaagtagccacatgcaaataaaagttgtttggtaaaatggaaaaaaaaaaa

SEQ ID NO: 1876 - DNA, 1009 bp, Homo sapiens
  ref <308>: DATABASE ACCESSION NUMBER: U18919
  ref <309>: DATABASE ENTRY DATE: 2001-06-18
tcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcacttgtgggagccgcatatcacccaacgccaggtggagaaagcctgggccctcttgcagaagcgcattcccaagactcatcaggccctcgactgaaaggttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctg

SEQ ID NO: 1877 - DNA, 3288 bp, Homo sapiens
  ref <308>: DATABASE ACCESSION NUMBER: U41387
  ref <309>: DATABASE ENTRY DATE: 2001-06-18
cttcctctccacgcggttgagaagaccggtcggcctgggcaacctgcgctgaagatgccgggaaaactccgtagtgacgctggtttggaatcagacaccgcaatgaaaaaaggggagacactgcgaaagcaaatcgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttatagatgatatataaaagtacattttaatagaagccagggtttaaggaatttcacatgtataaggtggctccatagctttatttgtaagtaggctggataaatggtgcttaaatggtaatgtactccacttcttcccattggaagattaacattatttaccaagaaggacttaagggagtagggggcgcagattagcattgctcaagagtatgga

SEQ ID NO: 1878 - DNA, 1496 bp, Homo sapiens
  ref <308>: DATABASE ACCESSION NUMBER: U45975
  ref <309>: DATABASE ENTRY DATE: 2001-06-18
gcacgaggcctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctcaaaaaaaaaaaaaaaaaaaaaaaaa

SEQ ID NO: 1879 - DNA, 1418 bp, Homo sapiens
  ref <308>: DATABASE ACCESSION NUMBER: U49835
  ref <309>: DATABASE ENTRY DATE: 2001-06-18
agaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcgcctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccttgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagta

SEQ ID NO: 1880 - DNA, 4858 bp, Homo sapiens
  ref <308>: DATABASE ACCESSION NUMBER: U56725
  ref <309>: DATABASE ENTRY DATE: 2001-06-18
ggaattcttttttttttttttttttttgaaacagggtctcgctctgtcacccaggctaaagtgtagtgccgcgatctcagctcattacaacctctgcctcccaggttcaagggatcctcccacctcagcctcccaagcagttgggaccacaggcatgtgccaccatatccggctaatttttgcttttttcatagagacagggtttcaccatgttgcacaagtcggtcttgaactcctgagctcaagtgagctacctgctttggcctcccaaagtgctgggattacacatgtgaaccaccgtacccggccccaaaaatgctttcttaagcgtaactacgtaatgctagttgtagtttagattcctggatgttaacttaaaatagtcccataggaacccagtgtggtggctcacgcctgtaatcccagcctgaggcaggtggatcatctgaggtcaggagttcgagaccagctgggccaacatggtgaaaccctgtctctactaaaaacacaaaaaaattagctgggcatagtggcaggcacccgtaatttcagcttctcgggacgctgaggcagaagaattgcttgaacccaggaggcagtggttgcagtgagcccagatcgtgccattgcactccagcctgggcaacaagagcaaaactctgtctcaaaaaaatcaattaatttaggctgggcgcagtggctcatgcctgtaaatcccagcactttgagaggctgaagcgggtggatcatgaggtcaagagatcgagaccatcctggctaacacggtgaaaccccatttctactaaaaatacaaaaaaaaaaccccaaaaaacaaaaaaacaaaaacaaacaaacaaaccaaaaaaacacaacaactagccaggcgtagtggcaggcgcttgtaatcccagctagtcgggaggctgaggcaggaggagaatggagtgaacccaggaggcagagcttgcagtgagctgagatcgcgccacagcactccagcctgggcaacagagcgagactccatctcaggaaaaaaaaaattaattaattaaaaaaacagtaagataaataacacttctcccatttcagtaaaaggatgaagccagtttctcaatgaataaaaacaagagactgttgaatgtcaagttttatagacagtccagacaacacagggagacaccatctctacacacacacacacacacacacacacacacacacacacacacacacacacacacacaaaatagctgcgtatggtggcatgggcctgtagtcccagctattggggcagggccagggggtgggaggctgaggggagaggatgccttaacagggaggttgaggctgcagagagccatgatcacgtcactgtactccagcctgggtgatacagcaagactctgtctcagaaaaaaaaaaaagaaaaaagtcaagaatgcattcttgaggaattccaccaacaaaatgcaccaaatatagccaaagagttttctgctatatgccaagtggaaagctatgaagaaagagaagaacagaagcaggaggacattggttttcatctcctattctttcaagaagtaagatccattatcttttaaaaagtctaaacactggtaaggcaagacacaactcccacccataacactgcatctctgtcctcaggcaacaaatcaaatgtcagataaaagcacaatatctaccactcaacccccaggcttcagcacagaactcacaaacattctgctggctaaggcaaaaaggtgtactgtatttccagagagcttgcagagttctgagcactaatcccataatcctcatatctcaatctacacaaagcaccatcaggctaagaaacagattatatagcaggcacaacactcttgggtatgcaaacatgttaaggatcaaagtaagaaaagagtaactataggggccatactatatttgccaaaaagtgacttgtttaaaaattaaaaagaagccgggtgcagtggctcacacctgtaatcccagcactttgagaggctggggtgggtggatcacctgaggtcagtagttcaaaaccagcctggccaacatagtgaaaccccatctctactaaaaatacaaaattaggcgtggtggcaggcgcctgtaatcccagctactagggatgctgaggcaggagaatcgcttgaacccggaaggcagaggttgcagtgagccaaaatcgcaccactgcactccagcctgggcaacaagagcaaaactctgtctcaaaaaaaaaaaaataaaaataaaaacaaaaaagaaatccagtttacctccttgtgcaattcctaataaattgctgagaagtgatcttacataggaatcttgtataatttattctgatgcgttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggtcgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaaatgcaaatgtaaagtaaagctgaaattgatctcaaaaaaaaaaaa

SEQ ID NO: 1881 - DNA, 1203 bp, Homo sapiens
  ref <308>: DATABASE ACCESSION NUMBER: U58033
  ref <309>: DATABASE ENTRY DATE: 2001-06-18
gaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggcc

SEQ ID NO: 1882 - DNA, 4053 bp, Homo sapiens
  ref <308>: DATABASE ACCESSION NUMBER: U61167
  ref <309>: DATABASE ENTRY DATE: 2001-06-18
gaattcgcggccgcgtcgaccaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagcagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatatgtttaaaggccaaaaactggaaacagccatgccctgttttctgtgtatttgggatgggaataacaacattttgggggagctttttaaatctcagagaaaaggaaagtggcctgctctggcaggtatgtgcagtgtttcatttgttccagtcccaaaaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgcgggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttctaatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcagttcacttttacactgataaatataaattactaggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccagttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttaccaaattgtaatataactatgcaagtgtgtttattaaaagaacaccaactataaaaaaaagtcgacgcggccgcgaattccagctgac

SEQ ID NO: 1883 - DNA, 1327 bp, Homo sapiens
  ref <308>: DATABASE ACCESSION NUMBER: U66042
  ref <309>: DATABASE ENTRY DATE: 2001-06-18
gtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 1884 - DNA, 1716 bp, Homo sapiens
  ref <308>: DATABASE ACCESSION NUMBER: U67784
  ref <309>: DATABASE ENTRY DATE: 2001-06-18
gccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcagcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggttgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattytctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgactttcagttttgactaaggatgacactaattgttagctgttttgaaattatatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaaaaaaaaaaaaaaaaaa

SEQ ID NO: 1885 - DNA, 1668 bp, Homo sapiens
  ref <308>: DATABASE ACCESSION NUMBER: U68385
  ref <309>: DATABASE ENTRY DATE: 2001-06-18
gcggccgcccatcgacctggtcatcgaggatcgggatggcggctgcagggaggacttcgaggactacccagcctcctgccccagcctcccagaccagaataatatatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtgggggatgagtttggaactcggaaggaggaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcaccctcctgtcccccccacctcccttctctaatttcttctttttttaatgataaagtcttaaaacacagaaaaaaaaaagacttcagagaattaggtagatgaagcactttatacagtatatatcttcagcttaaatttgttttgagtattttttttatttttaagtaggcaaagatttaaaattttttatttttagtaaatgtttgaagcaaactaaaaagacgtgggcaatatttaccacaaccaaacagaacccacaaaattgtacatcttgatcttagcaaatatccttattgtagagacacttaataaagagatggtattttaatatctccagttctgaggtagggtgtaacttagttctacattgtgatttaggaatttttaaacctttcttcttcaggggagaagtgacccaggcctcgagtttagtgctaaagccactagtgtacttatgctgtcacctaaccaccacatgcgacatggaggcagaggctaaatataggggctttcttaagaaagtgagaggaaattagcaagcattattagtgtttgactactgctatcaagtgaattcaaaggaaacaggtttttatgtcatatttaagttacagaaaccaggcatgcttagaatagtttctaaggtgacagagcggccgc

SEQ ID NO: 1886 - DNA, 1843 bp, Homo sapiens
  ref <308>: DATABASE ACCESSION NUMBER: U68494
  ref <309>: DATABASE ENTRY DATE: 2001-06-18
ggcacgagcaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatctaaaaaaaa

SEQ ID NO: 1887 - DNA, 3492 bp, Homo sapiens
  ref <308>: DATABASE ACCESSION NUMBER: U74612
  ref <309>: DATABASE ENTRY DATE: 2001-06-18
ggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtttttggggaacaggtggtgtttggttacatgagtaagttctttagtggcgatctgcgagattttggtacacccatcaccagcttgtttaattttatctttctttgtttatcagtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacaaaaaaaaaaaaaaaaaa

SEQ ID NO: 1888 - DNA, 4203 bp, Homo sapiens
  ref <308>: DATABASE ACCESSION NUMBER: U75968
  ref <309>: DATABASE ENTRY DATE: 2001-06-18
ttcactgaggggacccgccagtttcaaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacattgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtgttttcggcccctccctggctcttaccaggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagcgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgyctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccattaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggttaaaaaaaaaaaaaaaaaaaaa

SEQ ID NO: 1889 - DNA, 1792 bp, Homo sapiens
  ref <308>: DATABASE ACCESSION NUMBER: U79293
  ref <309>: DATABASE ENTRY DATE: 2001-06-18
tgcagatgccctgtgccgtgcagctcagcatgcataggtggggtagttggttgatgagcttttctttaggagaacagattttgagctatctttttttgttggaaccctgcacacaactgtcattatgtagatggttttcctctcaggtggttggttttctccagagaagaacccttgaatctcctgcctgtggaggtggacgtgtggttggtgttctgggtgccccttgccctgagctctgttctccatggtgcctgtttcctgggtctgcagccccttctcagtttctctgaagagtaaacctctcccctgcttggggaggagcatgggggttacgtagtagcctggctgcataacatgggcttagtagctcagttttccatcatgaaccagagcctcatctttcatggttcctgtgcctccgagggctgggctactggggtgtctgtcagtccagatggctttgttctcaagtttcctccacagtggatatgaatgtttgcaacttacactcaattacaacgctttcctctacttttctccaagtttgctgaaatctttatttgtggatatctcctctctttttgctttgtcctcataggttaaaacgttttaaaattccctaacagtaggaaatttagtagggttttggaagggagaggaggtgtaagatggtcactcttccatgtttaactggaagtggaaagtctaggcttttgcttcaggcctgggaggtgcacatgaaacagtccctcccagtggctgcctggggggtccctgaagggtgtgagaccaccgtgaatcctggggcagggcacttgcagtacatgtgctatgtgtttgctagtattgttttagatgtttgatctcctagcctttgcttttctttgtatttttcctgctttagtccatttcccttctagctccttctgttctcatttatcttctgctgctgcttggagttacattttcagcaagtctgtaacacctctctgaaccaaaggctctcaagttcatctttctttctccaagcctacgcctgtgctgctgtcatgagtggcgagcttctgtttcttctgtcttcttgtcagtcccaagtgcccttttacagagaatgcctgtttttcactgtctagctcagttaccaggagtccctgtgaatgacacccacaggtccctcaaagaagtcagatttctcttggacctgataaagcaaacaaaatgtgacccaagcaggctgagttggacgggtcccttcttaccttcgccctctgccatgttgacattcttatctgatggcacaggctgggagttcaggatccacttagatggggtccgttcaggggataccagcgttcacatttttccttttaagaaagggtcttggcctgaatgttccccatccggacacaggctgcatgtctctgtgagtgtcaaagctgccatgaccatctcggtaacctactcttactccacaatgtctatattcactgcagggctctatgattagtccataatgtaaatgcctggcccaagacgtatggcctgagtttatccaaggcccaaacaattaccaaacattcctcttagatagaagacagatttctttcccttggcaaagatcttctactaagatatgttacaggatgttttacattctcttggtcttataataacaccacgcccaatccagtatttgatgcgtcggtggtcactcggaaggttgttattttaaaaatacttattgttctcagtctgcagttctcacagctgtaaaaaaaaaaaaaaaaaa

SEQ ID NO: 1890 - DNA, 2224 bp, Homo sapiens
  ref <308>: DATABASE ACCESSION NUMBER: U80736
  ref <309>: DATABASE ENTRY DATE: 2001-06-18
aaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcagcatacagagccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccccgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaaatgcaagtgactaaattcaattattgactaatttccactttttatccatgacttctccaaatcaaaccacagtatatgttgtaacaaatatctatgaccactgttagcccattatattcattccaattagaagaaaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgttgcaacaacaaagaaactgttcacttttcaaataaaatgatatgtcagggaattc

SEQ ID NO: 1891 - DNA, 1639 bp, Homo sapiens
  ref <308>: DATABASE ACCESSION NUMBER: U82987
  ref <309>: DATABASE ENTRY DATE: 2001-06-18
ccgccccctccggcgtgttcatgcccccggggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgactgagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtggaaaaaaaggccttcgtggcctcgagagatc

SEQ ID NO: 1892 - DNA, 6817 bp, Homo sapiens
  ref <308>: DATABASE ACCESSION NUMBER: U83115
  ref <309>: DATABASE ENTRY DATE: 2001-06-18
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggcccaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattataagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatatgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactaaaaaaaaaaaaaaaaaaaaa

SEQ ID NO: 1893 - DNA, 2402 bp, Homo sapiens; identical to SEQ ID NO: 1864
  ref <308>: DATABASE ACCESSION NUMBER: U89715
  ref <309>: DATABASE ENTRY DATE: 2001-06-18

SEQ ID NO: 1894 - DNA, 1896 bp, Homo sapiens
  ref <308>: DATABASE ACCESSION NUMBER: U90916
  ref <309>: DATABASE ENTRY DATE: 2001-06-18
gtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccagataactgtcttcactgtgaccagtcggagtccctgcttgcttgtgaagaaggggcttttgtaccttgttggagatgccacctcagaagttcacactgtgcaggaaaaaggttttattctctcctggcatacattagaatgtcagatgcctgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaaaaaaaaaaaaaaaaaaaaaaaaaa

SEQ ID NO: 1895 - DNA, 2064 bp, Homo sapiens
  ref <308>: DATABASE ACCESSION NUMBER: U92544
  ref <309>: DATABASE ENTRY DATE: 2001-06-18
agaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagacctcagaggctcgggaggcacctgccacccaggcctcgtctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacgaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggctctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattctttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttcaaaaaaaaaaaaaaaaaaaaaaaaaaaaaaaaaaaaa

SEQ ID NO: 1896 - DNA, 2203 bp, Homo sapiens
  ref <308>: DATABASE ACCESSION NUMBER: U96131
  ref <309>: DATABASE ENTRY DATE: 2001-06-18
cggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcaagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctgccgaatgttatgttttgcttttatctcacagtaaaataaatataattaaaaa

SEQ ID NO: 1897 - DNA, 335 bp, Homo sapiens
  ref <308>: DATABASE ACCESSION NUMBER: U96394
  ref <309>: DATABASE ENTRY DATE: 2001-06-18
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagattgagtggttttatgtggtattcggcggagggaccaagctgaccgtccta

SEQ ID NO: 1898 - DNA, 607 bp, Homo sapiens
  ref <308>: DATABASE ACCESSION NUMBER: W61000
  ref <309>: DATABASE ENTRY DATE: 2001-06-18
tttttttcatttttgcaacaggcttttattacttttttttaaaacccatataagaaagacatttaaaaagaaaatatcctggaaacaaacacttacacactgagcaacacaaccaaagaaggcactaccagcagttactcccacctctgggagggaacaggtactcgatactatacttttttcagaggtttagacctcagcataggccttgggtctaactgtgctttagtaaagtctgaattgtccaataattttctcatttcataaacacccttatctctttatatatagctatatgcctttatgtgtatatatacatgactttttttttccttctcaaaaataaaatagccatccccatagagggaggttctcagcagcattcacagcggttgcagcaggagccatgccttctattaatgttagagacatgcaggacgaggaaaatgactctccacctgctccctttaatatacagcagggagagagttctaaagggagggaagtgataaggtgagcatgagatggtaaccagggttttgtggttaaaaaatctagagtgcgagctgtgtgccttgaaccctggagctatgccagtcatcgcgag

SEQ ID NO: 1899 - DNA, 1151 bp, Homo sapiens
  ref <308>: DATABASE ACCESSION NUMBER: X00437
  ref <309>: DATABASE ENTRY DATE: 2001-06-18
ctggtctagaatattccacatctgctctcactctgccatggactcctggaccttctgctgtgtgtccctttgcatcctggtagcgaagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttctcgacctgttcggctaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggttcaatacacattcttcttttgccagcgcttctgaagagctgctctcacctctctgcatcccaatagatatccccctatgtgcatgcacacctgcacactcacggctgaaatctccctaacccagggggac

SEQ ID NO: 1900 - DNA, 1304 bp, Homo sapiens
  ref <308>: DATABASE ACCESSION NUMBER: X00497
  ref <309>: DATABASE ENTRY DATE: 2001-06-18
ttcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatgtcccaccctgtacctcatcccatgagacctggtgcctggctctttcgtcacccttgtacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttggacccataatcctttctgccgacccctagttccctctgctcagccaagcttgttatcagctttcagggccatggttcacattagaataaaaggtagtaattag

SEQ ID NO: 1901 - DNA, 1643 bp, Homo sapiens
  ref <308>: DATABASE ACCESSION NUMBER: X01394
  ref <309>: DATABASE ENTRY DATE: 2001-06-18
gcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaattgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgctt

SEQ ID NO: 1902 - DNA, 935 bp, Homo sapiens
  ref <308>: DATABASE ACCESSION NUMBER: X03084
  ref <309>: DATABASE ENTRY DATE: 2001-06-18
ccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatggacacagtagggcttggtgaatgctgctgagtgaatgagtaaataaactcttcaaggccaaggaacagtggtctaattcaactctgtgtcccagcactggcacaccagaagtgccatgctcagaaatgttggttacatgaatgaatgaaccatgaatgaatg

SEQ ID NO: 1903 - DNA, 2212 bp, Homo sapiens
  ref <308>: DATABASE ACCESSION NUMBER: X05610
  ref <309>: DATABASE ENTRY DATE: 2001-06-18
ggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccatccaaccagggacagtgggtccccaggggaggcgaggcccccctggggcaccgggggagatcgggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaaccaaaaattggttttatttttttcttaaaaaaaaaaaaaagtctaccaaaggaatttgcatccagcagcagcacttagacctgccagccactgtcaccgagcgggtgcaagcactcggggtccctggaggcaagccctgcccacagaaagccaggagcagccctggcccccatcagccctgctacgacgcaccgcctgaaggcacagctaaccacttcgcacacacccatgtaaccactgcactttccaatgccacagacaactcacattgttcaactccttctcggggtgggacagacgagacaacagcacacaggcagccagccgtggccagaggctcgaggggctcaggggctcaggcacccgtccccacacgagggccccgtgggtggcctggccctgctttctacgccaatgttatgccagctccatgttctcccaaataccgttgatgtgaattattttaaaggcaaaactgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccaccttgtccctgagatttaacccctccactgctgggggtgagctgtactcttctgactgccccctcctgtgtaacgactacaaaataaaacttggttctgaatattttt

SEQ ID NO: 1904 - DNA, 1597 bp, Homo sapiens
  ref <308>: DATABASE ACCESSION NUMBER: X07203
  ref <309>: DATABASE ENTRY DATE: 2001-06-18
aacaaactgcacccactgaactccgcagctagcatccaaatcagcccttgagatttgaggccttggagactcaggagttttgagagcaaaatgacaacacccagaaattcagtaaatgggactttcctggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtcccttttgcatcattgttttaaggatgataaaaaaaaaataacaactagggacaatacagaacccattccatttatctttctacagggctgacattgtggcacattcttagagttaccacaccccatgagggaagctctaaatagccaacacccatctgttttttgtaaaaacagcatagctt

SEQ ID NO: 1905 - DNA, 1026 bp, Homo sapiens; identical to SEQ ID NO: 509
  ref <308>: DATABASE ACCESSION NUMBER: X07834
  ref <309>: DATABASE ENTRY DATE: 2001-06-18

SEQ ID NO: 1906 - DNA, 1321 bp, Homo sapiens
  ref <308>: DATABASE ACCESSION NUMBER: X14356
  ref <309>: DATABASE ENTRY DATE: 2001-06-18
gacagatttcactgctcccaccagcttggagacaacatgtggttcttgacaactctgctcctttgggttccagttgatgggcaagtggacaccacaaaggcagtgatctctttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaacttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaaaaaaaaaa

SEQ ID NO: 1907 - DNA, 1433 bp, Homo sapiens; identical to SEQ ID NO: 502
  ref <308>: DATABASE ACCESSION NUMBER: X16302
  ref <309>: DATABASE ENTRY DATE: 2001-06-18

SEQ ID NO: 1908 - DNA, 3020 bp, Homo sapiens
  ref <308>: DATABASE ACCESSION NUMBER: X51630
  ref <309>: DATABASE ENTRY DATE: 2001-06-18
gttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagcctcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggactgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaaaaaaaaaaaaaa

SEQ ID NO: 1909 - DNA, 1224 bp, Homo sapiens; identical to SEQ ID NO: 1859
  ref <308>: DATABASE ACCESSION NUMBER: X52486
  ref <309>: DATABASE ENTRY DATE: 2001-06-18

SEQ ID NO: 1910 - DNA, 2019 bp, Homo sapiens
  ref <308>: DATABASE ACCESSION NUMBER: X52882
  ref <309>: DATABASE ENTRY DATE: 2001-06-18
acgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattgggataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaatccttcggattaaacatggaagttatgaagatgctgttcactctggagcccttaatgattgatctgatgttccttttatttataacaatgttaaatgcaatgtcttgtaccttgagttgagtattacacattaaagtaaagtacaagctgtaaacttgggtttttgtgatgtaggaaatggtttccatctgtactttggtcctctgatttcagatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattc

SEQ ID NO: 1911 - DNA, 3212 bp, Homo sapiens
  ref <308>: DATABASE ACCESSION NUMBER: X56807
  ref <309>: DATABASE ENTRY DATE: 2001-06-18
gaattcccgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagaatccattagaggacacactctgattaaaaattaaacaatgaaagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgggaattc

SEQ ID NO: 1912 - DNA, 915 bp, Homo sapiens
  ref <308>: DATABASE ACCESSION NUMBER: X57809
  ref <309>: DATABASE ENTRY DATE: 2001-06-18
ctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagccgctccaacgtcggaagtaataatgttaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcaacatgggatgacagtactgtggtcttcggcggagggaccaagctgaccgtccctggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgc

SEQ ID NO: 1913 - DNA, 819 bp, Homo sapiens
  ref <308>: DATABASE ACCESSION NUMBER: X57819
  ref <309>: DATABASE ENTRY DATE: 2001-06-18
ggccagcttccctctcctcctcaccctcctcactcactgtgcagggtcctgggcccagtctgtgctgactcagccaccctcagcgtctgggacccccgggcagagggtcatcatctcttgttctggaagcagctccaacatcggaggtaatactgtaaactggtaccagcagctcccaggaagggcccccaaactcctcatccatagtaataatcagcggccctcaggggtccctgaccgattctctggctccaagtctggcacctcagcctccctggccatcagtgggctccagtctgaggatgaggctgattattactgtgcagcatgggatgacagcctgaatggtcggtatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaacc

SEQ ID NO: 1914 - DNA, 2325 bp, Homo sapiens
  ref <308>: DATABASE ACCESSION NUMBER: X58529
  ref <309>: DATABASE ENTRY DATE: 2001-06-18
ttttttaaagtaagatgtttaagaaattaaacagtcttagggagagtttatgactgtattcaaaaagttttttaaattagcttgttatcccttcatgtgataactaatctcaaatactttttcgatacctcagagcattattttcataatgagctgtgttcacaatctttttaggttaactcgttttctctttgtcattaaggagaaacactttgatattctgatagagtggccttcattttagtatttttcaagaccacttttcaactactcactttaggataagttttaggtaaaatgtgcatcattatcctgaattatttcagttaagcatgttagttggtggcataagagaaaactcaatcagatagtgctgagacaggactgtggagacaccttagaaggacagattctgttccgaatcaccgatgcggcgtcagcaggactggcctagcggaggctctgggagggtggctgccaggcccggcctgggctttgggtctccccggactacccagagctgggatgcgtggcttctgctgccgggccgactggctgctcagccccagcccttgttaatggacttggaggaatgattccatgccaaagctttgcaaggctcgcagtgaccaggcgcccgacatgggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgccgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggcaaaggagtctgggcccacgacctacaaggtgaccagcacactgaccatcaaagagagcgactggctcagccagagcatgttcacctgccgggtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggccaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaaaggggtggccctgcacaggcccgatgtctacttgctgccaccagcccgggagcagctgaacttgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccgagggggaggtgagcgccgacgaggagggctttgagaacctgtgggccaccgcctccaccttcatcgtcctcttcctcctgagcctcttctacagtaccaccgtcaccttgttcaaggtgaaatgatcccaacagaagaacatcggagaccagagagaggaactcaaagggcgcagctccgggtctggggtcctgcctgcgtggcctgttggcacgtgtttctcttccccgcccggcctccagttgtgtgctctcacacaggcttccttctcgaccggcaggggctggctggcttgcaggcacgaggtgggctctaccccacactgctttgctgtgtatacgcttgttgccctgaaataaatatgcacattttatccatgaa

SEQ ID NO: 1915 - DNA, 3318 bp, Homo sapiens
  ref <308>: DATABASE ACCESSION NUMBER: X59405
  ref <309>: DATABASE ENTRY DATE: 2001-06-18
gcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggaaaaaaaaaaaaa

SEQ ID NO: 1916 - DNA, 3587 bp, Homo sapiens
  ref <308>: DATABASE ACCESSION NUMBER: X66087
  ref <309>: DATABASE ENTRY DATE: 2001-06-18
gaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatacccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaaggtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatagtatacagggagcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaattttttgcttttgtttaaaaaaaaataatatggtaccttggtccctaaaaacagtctgcacttagaagttatatttactcagtgtttcagaagtggagaacttatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctattgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgactattaacatccaaaataaagcatctgtgtacaag

SEQ ID NO: 1917 - DNA, 549 bp, Homo sapiens
  ref <308>: DATABASE ACCESSION NUMBER: X69150
  ref <309>: DATABASE ENTRY DATE: 2001-06-18
cctctcttccacaggaggcctacacgccgccgcttgtgctgcagccatgtctctagtgatccctgaaaagttccagcatattttgcgagtactcaacaccaacattgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagttatatacaaaaaaa

SEQ ID NO: 1918 - DNA, 454 bp, Homo sapiens
  ref <308>: DATABASE ACCESSION NUMBER: X72475
  ref <309>: DATABASE ENTRY DATE: 2001-06-18
ctcagctcctggggctcctgctgctctggctctcaggtgccacatgtgacatccagatgacccagtctccatcctccctgtctgcatctgtaggagacagagtcaccatcacttgccaggcgactcaggacattggcaactatttaaattggtatcagcacaaaccagggaaagcccctaacctcctgatctacgatgcatccaatttggaaacaggggtcccatcaaggttcagtggacgtggatctgggacacattttactttcaccatcagcagcctgcagcctgaagatattgcaacatattactgtcaacagtatggtaatctcccattcactttcggccctgggaccaaagtgcatatcaaacgaactgtggctgcaccatctgtcttcatcttccgccatctgatgagcagttgaaatctggactgcctctgttgtgtgcctgctga

SEQ ID NO: 1919 - DNA, 2343 bp, Homo sapiens
  ref <308>: DATABASE ACCESSION NUMBER: X73617
  ref <309>: DATABASE ENTRY DATE: 2001-06-18
ggaagttgactggaccagggagatgaccacagctgctgacctctcactcactgctgttcttccttgggtgaaactggcatttctacattttcttacagcacatttggggaatacaaaaaggcctttcttaaaaactattcttgtcttgttttcatgttgattctattgcaaaagagagttatatgagccacctcatacggaatttctaaattcaaacctctagagagatttacccaagtgctttgctttgcagtttgggaggatggatttgaagagagattgatttttttgtaggcaatcaccggccacagttgctcattctaaagctgactgctctgtaaatcacccagtgcttcatgccaccctttctcctcttgctgtgccacacgttatctgcctttaaagcagcagcactggtgtctgtaaaggccttaaccctggagtagtgatggagccaagacccacccctttgacagtgccagctttccaacacagagagctgagtatgggtctaggaagtgagagcaatgtaaaacaatagaaagcaacagttcagagcactgcatcaagtgtactgtgctggaaaggtccgccataggaaatatggtcctccatactcctcagacaacagccttccgaaagcaaacctgtccctacctgcagatgattaaccatctatgaaccggctgggtaagcaacaagtgccatctttcatggagctgagccttaaagatcctccagtcctaaagctgacgggaagaaggtaggtgggagcagcgctgaggtttttggaacgtcctcaagtgctgtgacaccgataaactcatctttggaaaaggaacccgtgtgactgtggaaccaagaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttgtaaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaagatataggactctttttttactcctacaagtgatacactttgaaaatgatgttttgttccttttgactttctttaccttttgaagtagaaagtgggaaccaacaggttcacagcttcattcctcatgaggcaaataggccttgggagaagaagagcgggtgcccttttatctaaacatggaaggctctgctcaactgagcactagatttgctacaaaccagcatcatcttcttcctcctgtcctcacggcttgtcccaccctctatgttcacttcaggagccacactagagattctgcatggcgtggaggacaaagtttcagcacgttctgcctctcctaatactttacaaatgagattacatttgaatttgctaatactttatgagcaggcaatgaggtttccaaaatctcatctaaatactctccaatctattagcaaaaatcagagtaaaatacagaggaaaggcactgctttctgttaattgattagctccctctgagttccaggcactatgctgagagtacaaagaagacacaagtctgctttcaagcaactcactgtgaaagtgtttttgaagggaggaacagaaatgagacccctatctttccctataaaaacaacatttttactgtcttttgcctgccaatctgtatttgaaaccattggacactgattctctggcctgggactttggcattgatggttttctgcctttcttctcagcctctgcctctattgcatttattaaact

SEQ ID NO: 1920 - DNA, 3273 bp, Homo sapiens
  ref <308>: DATABASE ACCESSION NUMBER: X74794
  ref <309>: DATABASE ENTRY DATE: 2001-06-18
gaattcggcacgagcgagtcgcgacgtcgtcggcaagcggccgccttccacgtaacgcgcgccggcgggggagggcgttggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagcactgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagcaatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcatgcaattctgcacgccacatgggtgtggtcatgcaatcatcagttggccgccatcagtgtaaatagagcttaaagtcatggtttggctgcataaaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagatcgcttaaacccaggcggcagaggttgcagtgagccaagatcgcgccactgcactccagcctcagcaatagagtgagactgtctcaaaaaaaaaa

SEQ ID NO: 1921 - DNA, 1438 bp, Homo sapiens
  ref <308>: DATABASE ACCESSION NUMBER: X75315
  ref <309>: DATABASE ENTRY DATE: 2001-06-18
gcggcggatgcagtacaaccggcgctttgtcaacgttgtgcccacctttggcaagaagaagggcaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagaccctaaccccatcatcgacggccgcaaggccaacgtgaacctggcatatctgggcgccaagccttggtgtctccagacgggctttgccattggcgtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggtctacgcccagtacccaccggccacctatgaccagtacccatacgccgcctcgcctgccacggctgacagcttcgtgggctacagctaccctgccgccgtgcaccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggacttttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtctgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaacctaggaa

SEQ ID NO: 1922 - DNA, 334 bp, Homo sapiens
  ref <308>: DATABASE ACCESSION NUMBER: X79782
  ref <309>: DATABASE ENTRY DATE: 2001-06-18
tctgagctcacgcagccgccctcagtgtctgcggccccaggacagagggtcaccatctcttgctctggaagcagctccaacattgggaagaattatgtatcctggtaccagcaactcccaggaacagcccccaaactcctcatctataaaaataataagcgaccctcagggattcctgaccgattctctggctccaagtctggcacgtcagccaccctgggcatcaccagactccagactggggacgaggccgattattactgcggaacatgggatagcagcctgagtggtggccgggggatattcggcggcgggaccaagctgaccgtcctag

SEQ ID NO: 1923 - DNA, 735 bp, Homo sapiens
  ref <308>: DATABASE ACCESSION NUMBER: X82693
  ref <309>: DATABASE ENTRY DATE: 2001-06-18
cgacatcagagatgaggacagcattgctgctccttgcagccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccggcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttattttgtactcaaatctctacatggagataaatgatttaaacc

SEQ ID NO: 1924 - DNA, 1793 bp, Homo sapiens
  ref <308>: DATABASE ACCESSION NUMBER: X83301
  ref <309>: DATABASE ENTRY DATE: 2001-06-18
gcaaagccagctgggctcctgagtccggtgggtacttggagaacttactacgtctagctggaggattgtaaatgcaccaatcagcatgctgtgtctagctcaagattttctccatccccttattttgggccagtggctgtcattacatatgagatgagtctcttgaagactacagatgaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagagaacaaagtcgtggacaaccaggctgggacccagggccagctgaaggtgctgggtgccaacctctggtggccgtacctgatgcacgaacaccccgcctacctgtactcctgggaggatggtgattgctcacaccaaagccttggacccctcccagcctgtgacctttgggaccaactccacctacgcagcagacaagggggctctgtatgtggatgtgatccgtgtgaacagctactactcttggtatcgcaactacgggcacctggagttgattcggctgcagctggccgcccagtttgagaattggtgtgagacatcacaatcccattattcagagcgcgtatggagtggaaacgcttgtagggtttcaccagggctggtgaattaccagatctccgtcaagtgcagtaaccagttcaagttggaagtatgtcttttgaatgcagaaaacaaagtcgtggacaaccaggctgggacccagggccagctgaaggtgctggtgccaacctctggtggccgtacctgatgcacgaacaccccgcctacctgtactcgtgggaggatggtgattgctcacaccaaagccttggacccctcccagcctgtgacctttgggaccaactccacctacgcagcagacaagggggctctgtatgtggatgtgatccgtgtgaacagctactactcttggtatcgcaactacgggcacctggagttgattcggctgcaggccctgcagctggccgcccagtttgtgaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcatttcaagatgaaaatggaccagccgcagtggctcacgcctgtaataccagcactttgggaggctgaggcgggcggatcacttgaggtcaagagtttgaaactagcctggccaacgtggcaaaactccatctctattaaagatacaaaaattagccaggcatagtggtgcatgcctgtagtcccagctacttgggatgctgaggcaggaagaattgcttgaacctgggaggcagagtctgcggtgaccgagatcatgccactgcactccagcctgggtgacagagccagactccgtctctactaaaaaaaaaaaaaaaaaaaaaa

SEQ ID NO: 1925 - DNA, 334 bp, Homo sapiens
  ref <308>: DATABASE ACCESSION NUMBER: X84340
  ref <309>: DATABASE ENTRY DATE: 2001-06-18
cagtctgtgctgacgcagccgccctcagtgtctggggccgcagggcagggggtcaccatctcctgcactgggagcaactccaacgtcggggcaggttatgatgtgcactggtaccagcagcttccaggaaaagcccccaaactcgtcatccatggtaatagcaatcggccctcaggggtccctggccgattctctggctccaagtctggcgcctcagcctccctggccatcactggactccagtctgaggatgaggctgattattactgccagacctatgacagcaggctgaatatttgcgtgttcggcggggggaccaggctgaccgtcgtag

SEQ ID NO: 1926 - DNA, 322 bp, Homo sapiens
  ref <308>: DATABASE ACCESSION NUMBER: X93006
  ref <309>: DATABASE ENTRY DATE: 2001-06-18
actcagccaccctcagcgtctgggaccccagggcagagggtcaccatctcttgttctggaagcagctccaacatcggggaagaaattactgtaaactggtaccagcagcttccaggaacagcccccaaactcctcatctatagtaataatcagcggccctcaggggtccctgaccgattctctggctccaagtctggcacctcagcctccctggccatcactgggctccagtctgaggatgaggctgattattactggcagtcctatgacaggagtctgagtggtgtggtattcggcggagggaccaagctgaccgtcctag

SEQ ID NO: 1927 - DNA, 2606 bp, Homo sapiens
  ref <308>: DATABASE ACCESSION NUMBER: X94232
  ref <309>: DATABASE ENTRY DATE: 2001-06-18
ctagaattcagcggccgctgaattctagcgagcaggcggcaggcacggtccgtgcggagaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgctaaggtgtattagcggacggccctctggccacctacccgagagatcgtagggtcacattcatccaacttcaccacttggctgcttgagattggttctgctcttttcttcattcctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttccgaattatg

SEQ ID NO: 1928 - DNA, 1860 bp, Homo sapiens
  ref <308>: DATABASE ACCESSION NUMBER: X98260
  ref <309>: DATABASE ENTRY DATE: 2001-06-18
gggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacggagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctagaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagtaaaaaaaaaaaaaaa

SEQ ID NO: 1929 - DNA, 4915 bp, Homo sapiens
  ref <308>: DATABASE ACCESSION NUMBER: X98834
  ref <309>: DATABASE ENTRY DATE: 2001-06-18
gagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactctcatgcaactaagtaagttgatgacttcactaccaagctgggcactgcttaccaaccacttcaagtccactggcagcttcccgcttcccctatgtgctagagccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggagcagggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctcccagagttatgagccctgattttgtctttttctctaagttcttaacatgttatgtccctagtggcttttctgtagtccctgagcttggaaattactgtgcttacaaggggatggccccctaaggaatttttcttccctcctcattctttgtacctgaggaacatagattctctgcagctttctcaaggggaaccctctccagcttccctggtgtgacccttcttccccctcctctctcctctccctttccctttggtaggtgcacctgagcacctacatttggcattgcagcctagccaaaaagggctggcagctgtctctggagggcccagtgccactcctctggggtgacctttctgctcagctggtgggtatgggtcccctatctttctagaaccagtatgtggcattcctgtcaaatgggctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaattttcccaggtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcacttttggtcagcatggttgatgaactaatgatgagagagttaaggaatgttgctagaacatagggcttgctggtacctatgtgactaagaaagggacatgatgtaagggaaaaggcctcaaattcttgtgaatgtggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagactttgggagaccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaagaaaaaaagaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1930 - DNA, 2046 bp, Homo sapiens
  ref <308>: DATABASE ACCESSION NUMBER: X99142
  ref <309>: DATABASE ENTRY DATE: 2001-06-18
ggatcttactgtggtggccgcgccttcagctgcatctcggcctgtgggccccggcccggccgctgctgcatcaccgctgccccctaccgtggcatctcctgctaccgcggcctcaccgggggcttcggcagccacagcgtgtgcggaggctttcgggccggctcctgcggacgcgacttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcagattcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaggagaacgcgccgcccgcgccggcctcccaatagccgccgcccgctgcctgcactctaagcgctctccccacgtccgctccgggagccatccccggtcgcaggagtccggggagggccgggaggcgccatggtctctctctgtagcctttcctggtagtcaatttgttgtcccgaggattcatctttttcttcctcctaccttctgttttttttttcatgtatgcattggtcttgcctgagctcttcctcaaagcttggaggaacgggggagggcccgggaatgtccctgtctgcacgacctgggactctgcccatgtgcttttgcctgtggaatggagacgcggaccctggatagtggttctatgactctgcgagggacaggcccacgcgtgtggggagaacatctccttccggggctgccctcaagagcttctgaaaaactaatgactctgctgccttctcctttgtctttgtttcactctgtgtttccaataaactcattgtagcgaatcaaaaaaaaaaaaaaaaaa

SEQ ID NO: 1931 - DNA, 3740 bp, Homo sapiens
  ref <308>: DATABASE ACCESSION NUMBER: Y07512
  ref <309>: DATABASE ENTRY DATE: 2001-06-18
aggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttatcgcttagatgacaatagtgctctttacatgttttctgtttgaacctaaaatagcagttgacatggtggtcctgaagcaaagcctttcaccagtaaagagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattacagctgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagcaacacaaattcaaatcattatacgtgtagccagaaactcaagcattttcactaaagttattaaaccaaactcctgtccaatttgacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaaccccg

SEQ ID NO: 1932 - DNA, 1673 bp, Homo sapiens
  ref <308>: DATABASE ACCESSION NUMBER: Y14737
  ref <309>: DATABASE ENTRY DATE: 2001-06-18
agcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtaattatggcatgcactgggtccgccaggctccaggcaaggggctggagtgggtggcagctatatggtatgatggaagtaataaatactatgcagactccgtgaagggccgattcaccatctccagagacaattccaagaacacgttgtatatgcaaatgaacagcctgagagccgaggacacggctgtgtattattgtgcgagagagggtcggtgggtacgatatactacggtgactactatcggatactactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatgagtgcgacggccggcaagcccccgctccccgggctctcgcggtcgcacgaggatgcttggcacgtaccccgtctacatacttcccaggcacccagcatggaaataaagcacccaccactgccctgggccctgcaaaaaaaaaaaaaaaaaaaaaaaaaaaaaaaaaaaaaaaaaa

SEQ ID NO: 1933 - DNA, 1132 bp, Homo sapiens
  ref <308>: DATABASE ACCESSION NUMBER: Z11887
  ref <309>: DATABASE ENTRY DATE: 2001-06-18
aagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttattggttaaactcctttatggtgtgactgtgtcttattccatctatgagctttgtcagtgcgcgtagatgtcaataaatgttacatacacaaataaataaaatatttaggccatggtaaatttaccgaattccgccgatactgacgggc

SEQ ID NO: 1934 - DNA, 313 bp, Homo sapiens
  ref <308>: DATABASE ACCESSION NUMBER: Z34893
  ref <309>: DATABASE ENTRY DATE: 2001-06-18
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatcaaccctaacagtggtggcacacactatgcacagaagtttcagggcagggtcaccatgaccagggacacgtccatcagcacagcctacatggagctgagcaggctgagatctgacgacacggccgtgtattactgtgcgagaggttaccagatggatgtga

SEQ ID NO: 1935 - DNA, 2093 bp, Homo sapiens
  ref <308>: DATABASE ACCESSION NUMBER: Z48633
  ref <309>: DATABASE ENTRY DATE: 2001-06-18
gccccatgcaagtccaaaacccagcaggcaaatcttagagctccaaaatgacctcctttgactccatgtgtcacatctaggtgatgcaagaagtgggttcccagggtcttgggcagccccgcccctgtggctttgcagggtacggcccccccttctggctgcattgagtgtctgcagcttttccaggcacacagtgcaagctgtcagtggatctaccattctggggtctggaggatggtggcccctttgtgacagctctgcttggcagtaccccagtggggactctgtgtgggggctccaaccccatatttccctttgacactgccctagcagaggttatccatgaggcccccccgctcccgtgcacagcaaacttttgcctggatttccaggcattttcatacatcttctgaaatctaggcggaggttcatgaacgttaattcttcggtgcatctgcaggcttaacaccacctagaacctgaaaggcttggaacttgcaccctctgaagccatggcctgaggtgtaccttggccccttttacctgtggcaggagcagctgggatgcagggcaccaggttcctaggctgcacacagcagggggttccggactcacaagagcatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctctagggaactctagaaaaaaattcttattttgactctttcccgcctatcttatgcccgtttctaatacaggtgcacagtgcctgcagtgtctttgcatagtaagagtgactttactccatttcccaacaaattcctcatctccctctgagaccacctccgcctggaccttattgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcagcccactctactggtatcaacttattgtattagtctgttctcacactgcaaataaagacatacctgagactgggtaatttataaaggaaagaggttgaattgactcacagttctgcatggctggggaggcctcacaatcatggtggaaggcaaggaggtgcaaaagcatgtctcacatagtggcaaggcaggagagagcatgtgcaggggagctcccatttataaaaccatcagatctcatgagacttagtcactaccacgagaacagtatggggggaaccatccccatgattcagttatctgcacctggccccacccttgacacgtgggaattattccaatgcaaggtgagatttgggtggggacccatccaaactatgtcagtatgttttgacttctggcttgattgctaggttgcatagaggacaaacatggaaattaatgaagtaccttaatatctggcttcagatcttagacaggatcagagggccagctcaaatttgcaaggaggggaggtagatcccaccattttatgggtgaatggcaaaatcaaacagaaattatgtgggatgggagatactgatgcaggcatctttggaaacattctacttagctaattttatgctaggctttaggtcaagaaggagagagagagctgacatgctgtggtacacacttattgtcccagcgacttggaaagctgaggcaggaggattgcttgatcccaggagtttgaggtagtgtgcgatgatcgttcttgtgaatagccactagccactgaactccagcttgggcaacattgagacaccctgtctcttaatttaaaaaaaaa

SEQ ID NO: 1936 - DNA, 1701 bp, Homo sapiens
  ref <308>: DATABASE ACCESSION NUMBER: NM_004222
  ref <309>: DATABASE ENTRY DATE: 2001-06-18
cggccggccgccatggctaacgtggctgacacgaagctgtacgacatcctgggcgttcccgcgggcgccagcgagaacgagctgaagaaggcatacagaaagttagccaaggaatatcatcctgataagaatccccaaatgcaggagacaaactttaaagaaataagttttgcatatgaagtactatcaaatcctgagaagcgtgagttatatgacagatacggagagcaaggtcttcgggaaggcagcggcggaggtgggtggcatggattgatattttctctcaccgttttttgtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggtgaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccagagtggaacccggagacattgttctttttgctaccaggagaaaagaacatggaggtatttcagagagatgggaatgatttgcacatgacatataaaataggacttgttgaagctctatgtggatttcagttcacattaagccaccttgatggacgtcagattgtggtgaaatacccccctggcaaagtaattgaaccagggtgtgttcgtgtagttcgaggtgaagggatgccgcagtatcgtaatccctttgaaaaaggtgggctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtaaaa

SEQ ID NO: 1937 - DNA, 1066 bp, Homo sapiens
  ref <308>: DATABASE ACCESSION NUMBER: NM_016405
  ref <309>: DATABASE ENTRY DATE: 2001-06-18
aggcggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttttgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggagtccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggcaaaaaaaaaaaaaaaaaaaaaaa

SEQ ID NO: 1938 - DNA, 1664 bp, Homo sapiens
  ref <308>: DATABASE ACCESSION NUMBER: NM_017690
  ref <309>: DATABASE ENTRY DATE: 2001-06-18
cgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtggctttttgggtgagccgtgtgtgtctgtctgttgtgtgtgtgcctcaagccctgttttcctgcgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccaccttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaaaaaaaaaaaaaa

SEQ ID NO: 1939 - DNA, 797 bp, Homo sapiens
  ref <308>: DATABASE ACCESSION NUMBER: Contig29
  ref <309>: DATABASE ENTRY DATE: 2001-06-18
cataatgattaagtagcccattaacctttccctttaaacaggccttttgatgttagttcttataccaaaaaaaaaaaaaaaaaacccaaaaccaaaaaacaaaccaacaatacatgaagatgtaagggaagagattaatgagatacaattcattaagtataaaaatatgttgtttcaaattcagaataatttaataactcttcgttatttcatatgtatctggaaatgggacagatacgtgtcctgatcctgtcacaagaggtagaattccagcatttggtacgacgttccaagacagggtcaaagtgacattcctgtttcccttgagaccatttccatcgtcaaagaaaaaatattttgttttcatatctttcagcagcagcttcggattatcacctctcaaaacaatcttgtcccataggacaacttggttcagagcattattttttgttgaatattctgctgataaataaagaaacaactgcttaacattccaatcaaatatattctctagatcagcagttatatcaaatgtgataaatcccagatcacttctttctctaggtccagtgaaatcttctacattttttagcatgatccgcgagacgtgcagccgcaccgggacgctcctgtctttgaaggcggtggtgatgaagcagccgaaggtgagcgccgccatcacgctcagcgagaaggcgaacagtgagttcgcccgcgacagcaccgtgttcatcgcgatcgtctcccacgagtccggactccacacgcacacccaggctcccgttccggcggcggac

SEQ ID NO: 1940 - DNA, 663 bp, Homo sapiens
  ref <308>: DATABASE ACCESSION NUMBER: Contig237
  ref <309>: DATABASE ENTRY DATE: 2001-06-18
tagttgtatataaaatttaatctcaccgaatgtacagttttcaaatttcacgtgtatattaaggaactgatgcatctgagcattgtcaaacaaacgggaagaagaagttaaagggcagcctggcattgatggctggtggagctctgaagcctgcctctgcaggtgcagacacatccacaaaagtaaccgcagtggaaataagaatcgtcctttcatttcctgagttggcctcaggaaaggaggatgaaattagatttgcagttacattgactattttggcctgtggattcagcagggatccgtatttagtccacttcacttctataaccaaagcccctgggagctggcaggaatccttcctgttgaatgactgggtgatgaagtggatgggcacccagtccagcatgtcctggggcctgggaatttcaaaaggggccacgtaatctgggaagccctgccccacagcaggctcttcacctctgtgctacgagcttacaccggagagcctccagtcagtcttagtttacagccagattgcatagtgtaaccaaataatactggggtccggaccccctccagtgctaagcagtcttgctcagttgtgctatgaagaatagtaagctgtccatatctatttgtggtctgaataatcccagacccctt

SEQ ID NO: 1941 - DNA, 479 bp, Homo sapiens
  ref <308>: DATABASE ACCESSION NUMBER: Contig263
  ref <309>: DATABASE ENTRY DATE: 2001-06-18
ttttacaaaataacacaatttattactattttgaaacaaatcacaaaataacattcagaaactcaacatttctaaataacttaattcacaataagtttagtcataaagtcatgctacaaaactcctgtgtataaaagattattaccaaggtattcatagatgttaaaatgttcttcagaatggagttggttctagaagccaaagattctggaatgatgctcgtaatcatgactgccagcctgggagaggagctggctatgcgcatgtgctcttagcttccaactcaccagtcttttgatgggagtgatccctccaggcagtagcacctcagaggcaggtaccctactgatcacagaggcaaagagcctcccacccatataatgttagacaactctacattcatttaaaatctagaggtgggaatgataattcgcaaagcttctattctgagtaggagaactacttgacacatcccccag

SEQ ID NO: 1942 - DNA, 550 bp, Homo sapiens
  ref <308>: DATABASE ACCESSION NUMBER: Contig292
  ref <309>: DATABASE ENTRY DATE: 2001-06-18
ccaggtggagtctgatgatctttatttcttagacagccctggactggggctatgaaacacagtcaccagcactatactcactcctagggtggctctgtctgtggcgttcctcaccatccccgggactcatagctcagtgccaccccccgacaccatgccctccagggggaggggacagcgaaggggagaggagggagagccctgcgcctggccctgtcctgagtccaaagattcccatggtgatcagagggcggtgttgggaatgtgggacacccttggccccgcctccctgacctccccactaccccaccaaaccagccttccttcctcctggcacttccagtgtccattcccggcagtgcaaatgtgttaggtggggtagggggtgggatagggagataaatagcagcctggcgttggcactggctggtgctctgtggtgggtatgagtaggggacggggccgccttcctggagacaagctcctgggtgctgtgatcagaagggtctgtagctccagtagctggagaacacggagatcttgtccttga

SEQ ID NO: 1943 - DNA, 556 bp, Homo sapiens
  ref <308>: DATABASE ACCESSION NUMBER: Contig372
  ref <309>: DATABASE ENTRY DATE: 2001-06-18
gccaatggctcttgatttttattatttttcacatgggcagcagaagatggagttgtcccatccttgctccccttgcattgaatgtgccttgggtcttaaaaccccggagtgtcattggagccccctcctcttgctcctagtgtaggagggacaaggaggaaagcactgtgagtatgtgtgttggaggggaggggtcccagctccctgagccaggctcagcacccctcagcagctccctgaggccctctctctgtgagacttttgacagacagcaggacagaaacatatagcagagaaagacataggcagactaggagacaggctacacacacacacagagaagctggccccttcctttggcatggttcaccctagccctggggataggatctaagggtagcgtatgggacctgagctttgggcttgcccgagagagagatggggctacttgaattcttgagaccccaaactccgagaccaaagaagttctctctcctgcctaacctggacccacacctcttcatgtccccacccaccacttagagactgagattgt

SEQ ID NO: 1944 - DNA, 584 bp, Homo sapiens
  ref <308>: DATABASE ACCESSION NUMBER: Contig382
  ref <309>: DATABASE ENTRY DATE: 2001-06-18
aggggtctggctttctctttagttctcatcacactagggctctcagtcacagagaaggcacttaaatgggaaggccacctgatgcaggccaaccatattcaccccccgcccacccgctctgggggaggggagcacaacgacatcaccacttgacatcccccttggcactggtatgtgggtccccttaaccgttagaccctggggagagcccaaggccttgacctccggaatcgccatgttaggaggaggggcttcagaaacagttggaaggcaggatatcctgggagctgcccccagccagcaggggatcaggcagggggctgtaggagatgggttggcacaggggaaggggacagcttggtcgggcttcctggagatccccaaaccccacagaaggtcccacctcctacagatcccccaaaggcaccggtgaaggatgggcaaggaggcactgatgagctggcgtagagaccccccacacacacttagctggtgggcctagcatatgctgggcacagaaggtgctcaagaaatgtttttttgaatgaatgaacggagcaaaggggtgtgagggacagaggaca

SEQ ID NO: 1945 - DNA, 624 bp, Homo sapiens
  ref <308>: DATABASE ACCESSION NUMBER: Contig399
  ref <309>: DATABASE ENTRY DATE: 2001-06-18
gattgtcaaaagcaatttaatttttggaggaaaaactgcatacgcagtacaacttatatctcaggcgaaatgtctcagaatcttcctgctcattggacagaaactcagcttcaccacattgccagccgggagaccatggaagggaactggcgccactgcccccagctgcccttcccaggggcaacttcaccaagatgtggaaatcctgggcccaccccacagtcagtcatcgctccatttcttcctggcaccaccacctccatctggcctgctccccaaccccccagaagcaggtgggcccaggctccaggccagtgcccccatcaagatcagacgtaaggcatcttcccaccgtcgctgtgctccggggacttttccaatccttccttcctctctgtccagaggctgccaggctgagggggccaccgtccaggtggaacaggcacaggcatcggggaatcagatggtatcagtggggatagggcacagcactttcctgggagccatgagacgccagatcttcctctggcagttcccactggctgtgggaagtggttttcataaagggggccaacttccaggaacatctagggctcgggagcaacccagcattgacagtgaatc

SEQ ID NO: 1946 - DNA, 874 bp, Homo sapiens
  ref <308>: DATABASE ACCESSION NUMBER: Contig448
  ref <309>: DATABASE ENTRY DATE: 2001-06-18
gaagctataattttatttcattactcttagtacatccacaactatttccacctaaatagatctttaaaataagcatacacaagtattgactattatctacaaatatttattgtaacacttgaatagaactacaggaagcccttggcactgatagaaaatattgattcactgttaggttacaaaaatttatacatagcaaaatttaatgctctttacataaaaaatattagactacttaaacaaaactttcaaaaattcctggtaatagctaccagaattagaaaagtaaaattaggctttagacactgcctcttctagaacactggactctgacagcacctccactgctggaaagaatagttaaatctgtcatgcaacaggaaaacaaaacactaagctattttggaacaactgttctacacagaagagagcttctcttaatttaaaaaaaaaaaaaaatcccaaataggcatttttaggcattaaccaaaaaagagaatccaaatggaatattatacttgatgttcaattttaatagcatcttgataaaggtatgcttcctttcatttgaatacatttctgcacatgtatgttataaaatccaggaaacagccaaaccacaagttaactcttaacaatgaatatacatagttaaccctatagtaagcagcccctttgaaaagcactgatgcacccaacagttatatggatcatttcataaagagcaacacaaagtttaccatcactaatacccagtacctacagtcacttaatgttctggaacacaataatgtaaaaggcaagtttcttttgaaaatggcttaaactcaagcagttctcttgctgaacatcaaactttattattcctgagaaa

SEQ ID NO: 1947 - DNA, 678 bp, Homo sapiens
  ref <308>: DATABASE ACCESSION NUMBER: Contig569
  ref <309>: DATABASE ENTRY DATE: 2001-06-18
aaaaatacaatctcttttttattaagaaatcctaatgactgaggtagatgatgctgttgtcagataccgaagtaatttggtttaagatatgaaaatgatgaaaccaagggaaagaaagcactgttttgaaattatcttcttttaaatttagatgcataattaagaatgcttccaatttaaggttctaagcacaaaatccagatatgtcatgttatggacttgcttcctgaagatgatatcagcagttgatagaaagaatccacactcttacagaacagcaaatcataaatggttgtctctgtgaagccagtagctttgcattcgatatttctatctgggctcattccaaatgttcaggatttggattcctgaaggcttcttcagcatttaactaattctttgttggctgaaggggctgggactgtttctccacacacaaactgatctttgtcataaatcacttttataatgagagagcagctaggacacgttgccacgtcttccccattctccaaatcttccttggtgatggagaagttatctccacatgggcagggatagaaatacgtctccgagtcctcgtcatattggaagtcctcgatttccacctcgtcatgaaacactgccatggtcagcgggggtggccgaaggggtaacgccccagcagtccgaggccag

SEQ ID NO: 1948 - DNA, 1292 bp, Homo sapiens
  ref <308>: DATABASE ACCESSION NUMBER: Contig580
  ref <309>: DATABASE ENTRY DATE: 2001-06-18
gacaagtgagaaagctttattaaagcacacatacatgtcagcggggtgggaaacaaaagagcaagttacagcccgggatcccaagttatgccttccattacaattgcaatccacaccaaatcaatctttgaaaacattcctccattcggttcatacatacagtagaaaccactgtggctgcccttaatccagtgtgcttataggaaatcagttagcagctgactctgttgaaagggatttcctctctgctatacactccttccacacacaactttgggtagaaacgcttatgagaatagaaaggtcagtttgatcaatgagtaccagaagatgaaacttagctcactagacccttctttgaaaagcctcaacacactacacccatgtaatatgtaggtcaaatttaggaaacaatagcaaaaacaggaactgaaagctcatcaagcaggaagtcagaataacagggagactctgtctacattcccttagagcccttaacagtccccagcctggagaaacactgggccaattgagataacacttggctcttctggttgacacagtgggatgtagaccatgctctgtttgataacacaccccagacgcaaacactaagacagatgtggtacatgaggatgaatatatctcatctttcattcgagaaatgaggagctctctctccaatgactgcagtatcagtttaaaatgcagaaaattcagcatgggctgtgagacactttaccctcagtcactctggtcctctgagatcagctagaagctctcactgggcatcctcgtgatttagtcaaaatacattatctaattaaagtgcttttcaaaagcagctccattataagagtcccccaaaggtctagtaaagatatctagaactggaaaaagcttgggaattctgttagcatttcaaagaaaagcattagaccaaagcaaggtggaaactgcttaaaaactagaaaagttaaatttaaaagccaagttccagaagtttatccaggtagaaaataagttaaaagcataaattggagaggagaaagaggaaggaactactcacctctccccaacattcctgtctttactaaccaaccctgcttcccagagccttaaaacccagactggtcctaatgcgaaaggtagccagggcttcctagggaagtaggaacaatgatagcaagacagaagataaaaagttgttttaaaagctgtttttaagttaagtgaaccttataaagacataagaaaaaatggactctgaaaataaactagattatacacag

SEQ ID NO: 1949 - DNA, 581 bp, Homo sapiens
  ref <308>: DATABASE ACCESSION NUMBER: Contig678
  ref <309>: DATABASE ENTRY DATE: 2001-06-18
aacatttgtgaccagttaactttaattttcaaaataaatctgcagtattttgcatgttagtaatacagtgctggtattgacaggtaaaatcatcatctgcttacatagaaaccttcattcaggagcacaccgtaggaggggaacggatacacaataaaaagcaaacgcaggccaagcagcgagccctagagcgtaacaggctggatgtcagatttaaggattatctaatacaactgtttagctgccaatctgataaaggggaagctctcaaccaggttacaaccagaagggaaaaacgtactctgccttttcgtagagcagtggctgtcgtgccttcaacacctggttgaatcagttcatcaacatcgaaactcaattccagttccaagacacagaatttcatcacacaacctattcggtaccccttttcagtggcccacccaaaaccccctcctgccatcgactctctccctcccaaaagaagacatgacgtggctttattattgcagacaagcttcttaagtgaataaagaatgcatacaaaatagtattttaactgaagtcatacaatgaagtctcac

SEQ ID NO: 1950 - DNA, 1365 bp, Homo sapiens
  ref <308>: DATABASE ACCESSION NUMBER: Contig706
  ref <309>: DATABASE ENTRY DATE: 2001-06-18
tttttctgaaaaaaaggtttattgcatatggaaatcaatagatatcttttacaaaaaaaggttagaataaagatctcacatttgtaaaggcacatatgaaacattttatagcaagcacaagggcagtgagaacatcaacaaggtccaatatctaaataagactttataaaaacagataggaaacagtgcaaaaaatactgtcaaagtcagttctatacacctcataactgtgtatacaactggcaagcataagcttatttactgatataaaatagcacatagaatagcatgcatagttttattttaggcttttcatattattaaattgatagggagtctataccaaagtacagttgacatgaatagtgataaaaatcactccccagcttagggaatgtcctataaacatctcacccctccctctgcttacaactacagtttggtagtaaggagactgtgcttccatcttgcaaggtggcaagcggccaccacagggggcgaatgtgctctcaggatcccaagtcccaacctggaatgcatttcttacggcaacaacataagagatggtgattaaatgtctgggtcagcccacaaaagccaaccagatctggctatcacagccctccatttgggctgtggtggaggtcagtgggcttctatgggtgacgcaagaaccttaagaacaaaccggtttctaagttggggacttgtctgtacatcgtttcaaaatgaaacctaataaatgtcatttgttttgaatgataccaaaattcacaacattttgtgaaacaaagatcaaggaaagcatcaaaatactgaagtagggagcacaagcctagtccagtgaaacaaactagattagcttgttacttgatgtaacacaagttacataaggttacacatttattagtaatttgcatatttaaacctttttttccactgaagtatcctcaagcacattaattagctattgaaggaacaaaggacatacataggaactcatctctgatgaagagtagctttatgtcagaaaggagaaggctaatgaatttttaagattccaaacagtggcaagaaagttcaaaggaaattgcagtaaaattgtacaatgttcaagttgaaaaaaaaaatggctctgaattacagcattcagttctatgctcaaggtatgtattagctaacactgcagttgtcagaggtgggaggcccctgagaaatgctgagaatgccaggcaccccagttctgagagccaccctagctaaactcaaagcagcattcttgagattttagcaaaaggctccgccccaagccacaaaaagatcccaatccaatcttttcagctttatcctctaaaaccttttgtc

SEQ ID NO: 1951 - DNA, 1100 bp, Homo sapiens
  ref <308>: DATABASE ACCESSION NUMBER: Contig718
  ref <309>: DATABASE ENTRY DATE: 2001-06-18
agactaccttttaataaactcaacttcccaatgttaaaaatcactgaatcaaaagatattttcaagcagccttttctcccagatatatattagatataaggaaatcgagtccaatttgaaatgaattttaaaacagcacacaaacatcacaagcccccagcgcacaatataaaatagttctctaaggaatataaacatttagtatattagaatgtgaaattacataggaaaataatctcttcaattagctaaaatcacttgcgaaagattatttattgcacaatttatcagtgggtactaagaataacacagatcctattattctcaacctctaaattcagtacatagtaaaattcattttctcaaactaaggttctatacataatcggagtaaaccctctgttactgagttaggatagggaaaacaaattccttagagttcatgaaaccacttcacaaatcctagaaggcacacattatatttcctatcatagtaagtacatttaagtacttcatatttaaaaaagacaaagctgtacagaatacaaaaagtgtacatttcatccattaaacaaatttacaacttttacgattagttattacagtagaactgacctaacattcacatctaaataattatcacccagttcaatagagcgaacaaagagctgtgctcatttatttatttgataaggctaataacattttatattcacagtagatcagtaagtgtcttggagctcatattgtaaaataaaaaggtttgggccctattgagtcactgggctcattgttaaataactccttgaaaggtgaaggattctggggataaaatcattggctatccctggaaagatccaaaactctgtaaggtaactctgttcacttttcagaaacattttaaaatagggtaatctgaattaaactcagcaagtctaatctaaaaggacaatttaaaatcttagagctggaaaagatttcagtggatcatctatcccaaggttttcaaaatatgttccatggaatactaagaatctatggaggagatacagggttctgcaaatttgacttgaatttaattaaaaaatttttttaaaaaa

SEQ ID NO: 1952 - DNA, 1080 bp, Homo sapiens
  ref <308>: DATABASE ACCESSION NUMBER: Contig719
  ref <309>: DATABASE ENTRY DATE: 2001-06-18
ctcttactcattcagattatttattaagagcaaaagtcgggccatcccatcgtgtgatattgcaacatgaaaagtcacatacatactaaggagaccccacagaattgagagcctttcaacagtacagagccatagattacaaagttaaaatacaaatgatcccccagatttggcaggaaacaagtacaatatgaggaggcctggaatggaagggcacttacttttcaataaggcagttacaaaatgggaaaaaaaacccccaaaaccttgtaccccaaaatatactctgatgagcgtacaggacaatagaaatgtaaaagaaggatcctgtataaccctctgtcattggcaaatgtgtgcattaagtgaaagcaactgaagggtttgtgttttaagatgcaagctagatgaaacaactgactgtagacatttctacctcaagaacagttcatatcttgccctaggctgggttctacctcaaaacaccagacccactttaccatttctaaccataaacttggaaacagtctataatacaatgaaaggaataaaaaggcacccctagagcaccatgcttcccaaggcatgatcttgagctcatctgcccttcggttcgactgcccagctcagtaacagggaccaggagccagggccagctgaattacacaacctcaaaggatcgcctggaaggcagatatctgaccaagagatcacagaccaagcacatttcatgagaatttaaatgctaggacaatactacctctcccaatagggcttgaaccctggttttaaataacaggctagatctgttttcccttaccactcattttgcaaaactcaactggcctaaacatttcgctcaatcttgagttctgcaggttggtccctgagagctaggttggccttgggaatttctgctcaattttaagttctcaagaatctgagggcagccgatttagactgaattagagtcatcctataggtcagaaagaagagaatgctagacaggtcaagagggccagaggttggttctgataatgccatatgacctcaggcacatctttttgagttttagtttcc

SEQ ID NO: 1953 - DNA, 1058 bp, Homo sapiens
  ref <308>: DATABASE ACCESSION NUMBER: Contig742
  ref <309>: DATABASE ENTRY DATE: 2001-06-18
caattaaatcttttctttttttttatgaaaaaagatcacacagaatttgccaacaaacaaaattccaaaagaaacataaaaaaaaaaaaccaataattcccccaaaaaacaaacccaaagtctggcttttccttccctcaagattgtctggttgaggccttggtttcccttgaaggcttggggcctggttaagtgctttctggggcccaagcagggaccctgggcttgggccggctcctgcctctccctcttctctccctaacaaacacttctctatcctggggggtgagtacagtacacttggcggggtgggcggggggtgtgctggggactgggaggccggtgaagccggtgctagacactataatctaacaggaaataaaaaataatattctgcacgtcagaatgttttttttttataatttcatagctatttttcacagttttaaaaagtttatatatatatttatatatatttatctttatatatataattaaaaagttgactccatttaaaggcttatgatacaggggcggggcgagtctcttggtacaataaaactgtacaggttaagaagtgccacctccctcctgggtggggaggggccaggcgtggccgggcgacagtttcagcaccattggggttttctgtagtgtgagggtttggaccagggtgggcctgtgccgggccctctccacctggtgcctttgacagacactccgggctgcaaccccacccggctctgttccccaagtctaggccatcctgagagggtgggggcagggcccctggcacagtcaggtaggccagctggcatcgggctgccctgtcccatgcacggtgggaggccttggggtgggctccgtgctaagggtgcttgggaagcccagagtgagcgtcagtttggttccttagaagcgcccctccccaccgaatccccagtctgcatggacctgggggcacccgggcccccacgcagcagcagcctggagggccggcctggccaagtgcttgcaacgtgctgggcaggaagggccgtccttcagctcatccttgt

SEQ ID NO: 1954 - DNA, 634 bp, Homo sapiens
  ref <308>: DATABASE ACCESSION NUMBER: Contig753
  ref <309>: DATABASE ENTRY DATE: 2001-06-18
ggtccaaaatttttaatagtatacagacaacctgttaattttttttttttttttttttgtaaataacaaacaccactttgttatgaagaccttacaaacctcttcttaagacattcttactctgatccaggcaaaaacacttcaaggtttgtaaatgactctttcctgacataaatccttttttattaaaatgcaaaatgttcttcagaataaaactgtgtaataatttttatacttgggagtgctccttgcacagagctgtcatttgccagtgagagcctccgacggggcaggtactgtgccagggcagctctgaaattatggatattcttatcctcctggttccttcggtgccaatggtaacctaataccagccgcagggagcgccatttctcctaaagggctacaccactgtcaacattatcctggactctgtgtctctctctgttgggtcttgtggcatcacatcaggccaaaattgccagaccaggaccctaagtgtctgatagaggcgatgatcttttccaaagtcagtacttacaaactggcattcttacaggctgcaccatttcctagtatgtctgctttaagcctggttcaacctctcatcgaatattaaatttttctttgtaag

SEQ ID NO: 1955 - DNA, 816 bp, Homo sapiens
  ref <308>: DATABASE ACCESSION NUMBER: Contig756
  ref <309>: DATABASE ENTRY DATE: 2001-06-18
tttaagtatttatatttttattccactctaacacctcagagtaaagaactgatgggcaggcatcggcttctgctgacaattgccaaccggcatgagattgctgagctgaggtggactctccagacactggaactggaactccaggcccaatggcctctggtaagaatgctgcaacgtgagacccttgagagagactgacttgttgaagatgaagagaaaaccaagagcctccagtccagttgttgaagagcaaccacgagccaacaccaaggagacaaggaagaagaagtccttctctcaaccgatgtccgcaagcacaaagaagagtcccaagatagcgaagaaaggaaaataactcaagggagagccaggaagaaaaatgctccacaaaaatccatggctttaagaatacttgaggaagggagcaggccaacaccctctggccacagtgaccagctgaatgaggaactctaacagaatgagctgcagttggagcaacagaggggacatagctggaacaacagagcgaggggacacagccggagcaacagagtgggaggatgccaaccatttcaactctctccctgagcagcgagtaatttcagggcaagcccagagactaggatccatctgagaagtcttcagaggtctgacccagagaactcaacaacaggatacgtcccatggtgatgaaaataaaatgaatcttgtgttcaccgttgtattcctcacgacttaagttaaaaacctgatgaaaagtggttaatctccataatgggtgttagctccatcgttttccaacgttagagataaccg

SEQ ID NO: 1956 - DNA, 975 bp, Homo sapiens
  ref <308>: DATABASE ACCESSION NUMBER: Contig758
  ref <309>: DATABASE ENTRY DATE: 2001-06-18
gtctatataaaatgtttatttttggaggactgtgtggtctggtgtttgggagggaactccacccccaccaggccaaccatggagctagaaacagagacagcaggaagggcaaagctggccactgcctgctccaccccttcacagcccagagcagaacagggtctgctctactctcaaggtgagtgacagagagccggtactgtttctgcccctggcataccctgagaacccatgtgacttctgtagtgctcagcccctgtgcccttcctgggcctgatccacatgtgtcaacacacacactccctctcacagtctccaaacagcactgcagagcctagctgcatctgccaggttcaaagaggaatttttcacatttgctcacttccaatctccatcttccttcctctgtctcccactctcccactctcagtagccgcatcccagccctgccatactcccttctcagggacaggagactcagtgggcagctggcctcagctctcctaacaggaaaaaaacctgtacagcattagtgccaggtcctgccctcccaagcgctgagcccagaaatttggacaaatgagctgcctcttaactgcaaaaaacaattttaaaaaagcaaaagatcaaacaaacagaccaaaaagcataaataaacagcagctgggccagcaaggaggaaggcagggtgaccctcagtggctccctgtgcccatctcagcctcttgccataaaactcagccatcagtggccaggatgacagcagttccgaagatgcccacactctctccaaggagcttcatctggttccagaactcaacacgccgcgtgttgtgccagtaagcaacattgccatcaatgagcagcatgacagggggcagcagtacagccaggatctgggcagcgagggtcacgtagtagcctgacagaaaggccagggccaggatgccatacagcacgaagaacagctggatc

SEQ ID NO: 1957 - DNA, 716 bp, Homo sapiens
  ref <308>: DATABASE ACCESSION NUMBER: Contig760
  ref <309>: DATABASE ENTRY DATE: 2001-06-18
taaaagggaagatgacaacttttattgttattacaaaagcaaatttaatttgtcatttgaataattgcaagagcagactaagggcttaatcctcacacaggcaccaagtcaggcacagtaggtagctacaaatcgtaagaaaaagctttctttcctacctagagcactcttccatgctttggaattaggctaaaaaactcaacaaacctgatcagttccctttaatcctgtttttttttttttttttttaaatgagatctaggtattaacctgctgtctagcgaaaactagtcactaagtcctggcctgagagatacccacatttcctttagaacaaacagaactaatacctgtgtacatttctgagagcctgatgtgtgagtccttaaaatgtagaccttgcaggaggcttagacctcagtttcacctaatgcatgtggaggaaatggaggtgagaatagtcacctgaagagtgcaagcgctccagctccagcacacacactcttccctgggcagcaggaaaaggaggtaacaaggacttgggctgacatctgaagcactaagctaatgtgcctggtagaggggagcctcaggaagcacaagatgtcattccacctgtgctgtccacaaacctgaggtttccacatcgttttaaagggcacagtggcaaatgtgacaaggcagaaaacaataaccatttcaaggatcacttaagg

SEQ ID NO: 1958 - DNA, 939 bp, Homo sapiens
  ref <308>: DATABASE ACCESSION NUMBER: Contig842
  ref <309>: DATABASE ENTRY DATE: 2001-06-18
taaagttataaaacaaaatttattatgcaatactttctcataatgaattgcatctctttggtaaaaataaactttataaacattttaataatcagagattagatacaaaaactaagtatttgtaagttgtttttaatatgagcaaagattggcaactgagaagtggttcacttgtgactggtcatctactggcagttataactcaaaccgggacaatttttatgctacatcagaaaagaggataaggaaacagtttgataacaaatttgttgaatcagaaagcattcttacactttcatttaaaaataaataatagttacaatcaattggcaattatacatttttatacactatatgatggcaacataatactttaaaattaagcacttagtttaataagaaatgtacaacgatttaaaaaataagttttgacaatggcactggcagttagatgcaaagcaatatgctttaagaaaaaaaatggcaggtataacattaaaatactcgaattcacctttcaataaatatttttactacatcattaacatactgaagtaaacttggtttaaatcaaagcttacacatttcaaactaaaaaaaaaaaaaaatacaaaaaaacacctgtaagatatatgtaaaccagaaagcctcacagtttcttaggtaaatgctgtgatcttcacaaaagggtgttaagttgttgtagtatttaagacaatggtctttacagctttgtgaagtattcacatctgttgcttaaattgctggcaaaggcctcctggtctaccaagacatatacattccctccttaacacattctctagtttgactttgtgctaaagtatatttaactgaacatctagtatgagccctttacataatgcctcagaaagtagcaaaaagaaaaaaatatatatatactaaactttactatataca

SEQ ID NO: 1959 - DNA, 931 bp, Homo sapiens
  ref <308>: DATABASE ACCESSION NUMBER: Contig848
  ref <309>: DATABASE ENTRY DATE: 2001-06-18
tcaatgtatatatctatctttatatacatacacatatatatctatagatatgtatctacaaggaactttcatatattttttgatcctcacagctgtcctatgaggtaggcaggtttcaggtattcacactaatgaggtattttccccataaacactgaaggatgccaagaaaagtttgcattcagatctagtttccatgtattcaaaaaatgaataagagtttaaaaagttgttttaccaactttagtttcagaattgacatcaggcatttcttattttaaaagtccacccttcagagaagataagaaatttctgaagtccacctttggaatcttttgggattcattctgactaagtaacatttttagttgagagaagtgtttctttgttttgctggtgttctttgaggagcaagtagatactgactgtccagatgtaggtgttctgaaaaccgatgctgggctcttgcctttcgagccagacatgtcatgatttgggtttgcagtccttctctctggtgtcttcaggctgagtttacttgtaggagtggcaggattgctcttcaatgttgacacaaagcttctacttttaccatgatgtttcactgttctgttgcatgttttacaagtgatcaacaatacacttttggagtctttgaactttttcaccatttttgcttctttaaaactgagtgtatagtttctcgcttctcgattaagaagtttctgtattttgggtgtcaacctggctttgggtttgagacgcactcgagagttatccagaaccaacagctggaaacagtatggacacgtttcttcaaaagtgctcttatcatcgtgcgacgaagtgtaggcccagaggaggtagcggcttggcccgggcagctgtcgtcagtccccgcgtgcagcctcaaggtagtgcttctgtctca

SEQ ID NO: 1960 - DNA, 962 bp, Homo sapiens
  ref <308>: DATABASE ACCESSION NUMBER: Contig924
  ref <309>: DATABASE ENTRY DATE: 2001-06-18
gatgacttcaacttttattgaatgaggtctttattttttaacattacaaactaacactccctttctgaaaaggcagatcttacactcaaagacaatcttcaagcatttttttgttgttgtttaagaaattgagaggggaaatccacagtttattaacaagaagattcaaaacttcattttacagtaataatgggacaacacctaatacatttcacaatcaaaagtggttcaagctaagaatatctagaacagattttaaaatctgggaaagatgacataaactggacaattatcagtattgctcatcacaattttggctctaacagtacaggacaaatgcttgttttgcactgtgcctaagacggccccttcattaaggttcaccaggacacaggcagcatccccgcctcccagtcatttgtacaaatcattaaggcaaatctacaaaggaccagtaaggcactggggcacagcagctgactgcaggaagtctatgtaacttccggtagtaaaacagcctttaatgcagacataggtgtgaaaaattcagtgttttgtttttttttcagtgtcaacctgcacctaaagcacaaaaggtcacttcaagtcacttcaatgtaataaacaattcccattcatcacattaccagtgaaaagagaaataattcactgggctagaaggaattagaagcaggaataaagaaaatgccctttggtttacacttactaaagagaatgtctttaactctccaaggaataccattccgctttgtgaaattataccaattaattaggactcctctatattcccattaatgtcggatcattacataacttcaatagaataaacacttttttcccactttgctataataatagctagggatacctcaacaatataataatggtttaaattatgaccatttctctttggccttgtggtatttaagcttagagaaaaa

SEQ ID NO: 1961 - DNA, 575 bp, Homo sapiens
  ref <308>: DATABASE ACCESSION NUMBER: Contig974
  ref <309>: DATABASE ENTRY DATE: 2001-06-18
cagaatccaaaaggactttattttctggcactgggaggcgccctgaggccacagccttttcccagggctgctggcagggtcccagggctgctggcaggggttgtggtcctgttgagcagaggagcgacgccgctgccctggcccccgctgtccctatgatcctgcactctggggtgggagctacatatcatccttggacaccaggcagtagaagtctgtgcgggcactgtagtttcgcgagccgagatccgagacgtccacttcgctgctccggctctctcccagcgagaccccactggtgtgcggtggagctgatggctctccaaaaacaggcccccggacacccaggtcgccctcagggtccgggtccacctctgagtccagggcccggccctcagggactcggcctcgaagaatcagcatggggtccttgtcgtcctgcagctgcgtctgggggtctccttccacaggcctgtactgcaccttccgcggcagcgccagctgcacttctttccaaaaatcggaggaaggagtcacggagccgggcctccagagcagcaaggtcaccaggtggc

SEQ ID NO: 1962 - DNA, 752 bp, Homo sapiens
  ref <308>: DATABASE ACCESSION NUMBER: Contig1018
  ref <309>: DATABASE ENTRY DATE: 2001-06-18
caaacatgtaatcttttattcagtacactctcaaaacagcatttctgtatctagttccaagctgggtgatcctgcggccccaaaggtagtgatgactctgctgggaggagacacagacctcccagttcagtggatcccgagtgagtcagaaggtgagactggaagcagcagggtccttgagggaagtaggctctccttgaaggataagcaatggctgcatgaagtagcaggtattgaagctagggctttgaaggatgaataggagcttgccaaacaaagaaggtgggacatgcaaaccaagtggagggactgtggcccaaactcagggatacatggatggagtagcaggagaaaaacagactgggggagcaggaagagtcagtgtgagctttctccagatccaaaatcagcagcctgtcattcaaggccaagacattccacaatagttccccttggccctgtcaagcctatcaggcctggagcttcctcaaagcagctctgacaactccagccactgtcatctcccctctttgtgtcacgaggaccatgcactttggtgcatggtgacattcagtgggggctgctttcctcggtgtggctgtgggaccttaggcccatgcctcagtttcccaacctggaaaatgggctgcaggaagccacttttgcaacttatgtttatctcaggccagggaggtcttggacaaatgatgtgaaggaagaagagaaaaatggaagatagggagggagaggaa

SEQ ID NO: 1963 - DNA, 606 bp, Homo sapiens
  ref <308>: DATABASE ACCESSION NUMBER: Contig1056
  ref <309>: DATABASE ENTRY DATE: 2001-06-18
cagcggtttcaggctttattaacaaacggtgtaaaaaaccagacggatctggaggaagggacagggctgcccgtctcagctctcaaccttcccagagaggggccaggcctggcagccctgtgcgtcgcgcctcctaagcagtcaaccttgtcccctccaaggacaggcatctgacccaatccaggtcccagggaggcggagtcgcaaaccctaactctggggtgtattctgctcggcctcctctccccctccccagatagctctcccagcctggggcacggacagcacagactttgcagacatcacccggggaggtttctcagtgcagacaggagctgaggtaggggttggagaggctgacctcgagaggcccccgagggccaggaaggaaaaggagtcattccactctgagaagctcaaacacaacagacttcacactgctgacgggtggacagaggccaggctcctcccctcggcaggcctctgtttctgggcccagggtggttgaggactcactgagggagagcaggtaaaagaacccgcagacagtaggcgatcatcaggtgctggcgcccctccctcctcccctgcctggctgtcagtctg

SEQ ID NO: 1964 - DNA, 499 bp, Homo sapiens
  ref <308>: DATABASE ACCESSION NUMBER: Contig1061
  ref <309>: DATABASE ENTRY DATE: 2001-06-18
tttactttgaacattagcattaagttggttaccgtacacatccaaaggcccagcatctcagaaaaatcattaggcggcacacctgtaccagagtctcacaagaataaaatatacaatgctacattgagtggttaaaaatacacaaaaaagtagttttaacaatctataaattttttatacttaaaatcatgattgagttgaaataaaaaagtgcatttcaattgctaaaaaaataatatcggtatagttaacacaagggggaaatcagtacattgagggatctgacaggatgctggaaaaaatgactcagggaagccgggcagcatgggctcctttggagattcaggagcggagctcagttccacctcactgcagttccctggggccaagcagccctcctctccccagtatctttcccatcttaagagatcctgtcctacctacctgtcacctccccaacccaaagactcctctaaacttctttgcagcatgacagctg

SEQ ID NO: 1965 - DNA, 893 bp, Homo sapiens
  ref <308>: DATABASE ACCESSION NUMBER: Contig1129
  ref <309>: DATABASE ENTRY DATE: 2001-06-18
caagtttaagacaggtttattttattagtttttcctaaacttgtctcatgtttactgaatgattttcttagtgtaagaacgtgacctggagctttaacaaatcagtttggataacgcaacctggataaatgcttgtctgtacacaagccatcaattaccactctctgtcctggcctccatgaaaatccaattggtcttaaagcctgtctaagcagagagcaagcagaccacatcatcgtgtttcaacttgaaattcacccccatcccagcacccacacccttccccacacacacacacacacacaccaaaaaaaaaaaaaaacaacaattttttttttttttaagaagaaatggccattacggtctgggccagttgtaaagggttggcttaatcctgcagccagcacttttaaaatagctactggcttcacagcaggccagctggaactcttgaagcatgacaggtagagaacagaggatgtgctaagaacctggccttgttgtggtgcctcgaggcctccatgcatgcttacacaccaacataagtatactttccccttcctcctcctaagcaattgttctccattgcactttagagcctgtaacactcaaacttttcaatgttatctagagatggacaaacgcttaattctaactatgcaagatagcatcttatttctaacaacataggccaaaagtaacagagaggcactctgttatacagaatatcaatttttacaaagattcaaaacattaccaacaagccctgtaacagtttcttaaagcaggtaccaactctggcctcaaacacagggcttccctcggagtttccaaaatgcctcactcctgtcaacactgccccaaaaagcagtcagaggaatgctttggtatac

SEQ ID NO: 1966 - DNA, 920 bp, Homo sapiens
  ref <308>: DATABASE ACCESSION NUMBER: Contig1148
  ref <309>: DATABASE ENTRY DATE: 2001-06-18
ggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgttggatcctcctcctttctctggagctgtgcttggggctactctgacactctgtctcttcatcaccagccaaggaaaggggctttcgggtagggcgtagctgcagggcctccttgaagtacttgggaaggaggaagccatcagtattccctggagtcagaatcaccccattggcagagcggaagaagggtattccatctgctgccagagccaggggtccatcgatgaacacagctatttcacaatgggaccgcatgccactgatgataccggggtctccaggcagtcctggggccaggtgaatgtgcgtccttccctggcaggacaggcctttgagtaggatggatggccagtgcttccagaatgtaccatggactagcatcgggggcagggcctgcggtgtctccaggggcatcagctccaacttaggtacc

SEQ ID NO: 1967 - DNA, 854 bp, Homo sapiens
  ref <308>: DATABASE ACCESSION NUMBER: Contig1239
  ref <309>: DATABASE ENTRY DATE: 2001-06-18
ttgatttatgaagagtgtttaatgtttacaaagagcttttaatgatgtggaagatggtggtataataagtaggaaaaaactggttataaatgatatcacaatatgatgtcaacgatgaaaaaatgcacaaaaaaagacttttttaaaacgtcgaaacatcagagtggtctctagttggaggaataatttttttttttttaagacaaacttcttcatactttttgtacttttaaaatgatttactatgtacatggattacttccataatcaagaaaaaaagtaaaaacttttaaaatgctgtgaacgtggtttccatttttattttctctgatgggtgactgcacatcagcatcttgagttatgctaactacttaggctggtcacgacacacacacacatacagagaagtcacacaggctgtaccgggctggctgttgcaaatgtacatgaattacacgggttgaagttgtttggcagctagttaacatatgccacccaatgacgggacacaatctggtcacacgctgcctctcctgcctgttgctgttctttacaaaggtccgtgtgtcgggctggcaaagtggcatcctgctggcatctctgtggtggccccggaatggtggagtgcccaggtcagcatctactctgggtcccattctcaactgctctggccttgacatcagagcttccggttccctgctggctcttctgcacactggatccatgccagtccaggccccctccaggcacacacctgaggcagactgagagcacaactgacgctgtcctgatgtgaactgtgcccagacacaggatggggggaagcgggagatgtgaccacgacaccacacaca

SEQ ID NO: 1968 - DNA, 1182 bp, Homo sapiens
  ref <308>: DATABASE ACCESSION NUMBER: Contig1277
  ref <309>: DATABASE ENTRY DATE: 2001-06-18
gataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaa

SEQ ID NO: 1969 - DNA, 530 bp, Homo sapiens
  ref <308>: DATABASE ACCESSION NUMBER: Contig1333
  ref <309>: DATABASE ENTRY DATE: 2001-06-18
ttggaaagttgaatattttattatttacacatataaagtgagaatgaaaattgggcatggggcaagggcaggaagatgactccagctcagtcggtgatgatgagctcgtccaccccccagtcttcatagctcccatctggcaggtaacggcgaatgatgatggggatctttcgggccttgagttccttcatggcaatgagcagaggatctgtctccccctccagctccaccatcacaggggcacacatcgcaatctggagcgctcgggtgcccagcacgcgggctcgctcgtacttggtcatgtatggtgtggtgattcgcttctggttggcctgcggtcgctccccagaggggaggatctcgacattctcctggccttcctcttcggcattctccaagtcatctagcccttcatcctcctccacatcatcaaagtcgtcgccatcaaaattgtcctcgttgtctgacatgacacacctcgcctcagcgacccccgtgcgccccggtcccgccggagaccccaaacagcg

SEQ ID NO: 1970 - DNA, 845 bp, Homo sapiens
  ref <308>: DATABASE ACCESSION NUMBER: Contig1386
  ref <309>: DATABASE ENTRY DATE: 2001-06-18
aaacagtaattcttcagactttattaaaaaatgacataaagtgcatcttattaaaaaatgtataaaaaccacataaattcagggcccctgtgctgggcagtgttgatatcccttagagtggaggaaggtgagggatggagggtgaactggggactggggagaggaccagggtgcagttagttcctcgtgtttgagttcaaagatggagcgagggtggatatggtgggaaggggcacacgggttctcacgcaacaacggaggaaggcaggcgacagtctcttccctgaattctgagggaaaggcgtacattgtcacgaaatctctcctgagctcgcgctgtcctctcgtgtggccacagcctgatacaggctggaaaggtccaggagttgggtccgagcccaggacctggtgagggccgcagtgccaacctagccctctggtccctgaggtggtgggacgacggcagcaacaactacatcctcggctgactggcaaggcagaacgcacgcagcccaagctggtcctgaatctgcagtgagacagggcagccggtggcagcgggataatgtggaaggtgaagaggccagttggtgagggtttccaactctgtctcagacaaccactttggatgcatccccagcacccctgggaggccatgaactggagcagccgtgtgtgctgcatgccatgctatctcttccctctcattctagtttcacatttggaattgttttttaaacaaagggctcagtttacataaggagcactgttccaccaacctaggcaggcccccatatttggccaggacctctgggccacggctgtttgggtgtctgggtggtagg

SEQ ID NO: 1971 - DNA, 604 bp, Homo sapiens
  ref <308>: DATABASE ACCESSION NUMBER: Contig1389
  ref <309>: DATABASE ENTRY DATE: 2001-06-18
tatcttttaaaatgtagtctgtattattttcaccaaccaaaacacacataatatattttattataaaacattagcaatgttacttttgagatatgcaatctgaaaggtcacacttgtatttattaccaggaggaaataccagaggagtcacattagaaatcaaccagacagactcgtacgtggttatcgctacttacacagcattaaatgcgggttgaagcagcacccgctccgtgtttcagacacggacttggggtgggcaaggggccctgtaagagggcttcctcctctcagtactggggctctgcgtctcacctgctcccatctccaggcccacggctgacacggtatgcacagccagggtttccagactgctctcctgctctcacagaactctgtctgctctctggactctgcccttgaaactgagacctggacatgggggagacagtcgtttccttcttggctggaaactaagtcaacaaatgaaacaaacctagtctaaattccaggataatagtaaattacctggtttataaaaatacatgtccaaaatagttacttcctgggttgtgtacaatataaattacaaaaataaaataga

SEQ ID NO: 1972 - DNA, 858 bp, Homo sapiens
  ref <308>: DATABASE ACCESSION NUMBER: Contig1418
  ref <309>: DATABASE ENTRY DATE: 2001-06-18
gagagaacctgaacatttaatatggtcagcaccttgtaaggtgaaggtgtgttttttacacaaattataaataatgaaaaatatgcatttagaaaaagaagcagcagtccccttggcgggccggctcgaggactctttggttgagtggcaggtgaggccctgggtccagggtctgtcagagcccccctaggtcatctgccaggaaggccagcaggtagcggctgacatgtctgtcgatgatgacaggcgagaaaccgaggacgcgccgggtccctggcaggcccttggggtctggcggatagcagtacaggagcagggccagtcccacagcaaggcccaggccagccaggaagctcatgggtcccctgttactcagctcgccgctctggctgcccgagtctagctctgtgcaatctgagttctgcagagcgtggcggctgggcaggcggctgtgcaggggctgggcatggatatacagggctcggtagaactcctggcagtcccgctcaccgctccgctgcaggtggctcaggaggtcacagagccgcacacgcaaggatgccttggggttccggaactcctcagcaccttttccgcctccttgttggtaaggatctgtgggtagtaacggttcagctggaggatgatcctgtccacctgctgctcactcaagcgcccatggcctgtcaggaaaggcgtgtcctgcaccaggcggtcacaataggtctgatctgtcatggcgacggacacagcgccgcccgcagtccccagcggtctgccccgccgcggtccgcccctcggtcagccgcccggtccaccagctccagcgaacgccgcccgcggccgtgctcgcccgcc

SEQ ID NO: 1973 - DNA, 1418 bp, Homo sapiens
  ref <308>: DATABASE ACCESSION NUMBER: Contig1462
  ref <309>: DATABASE ENTRY DATE: 2001-06-18
gatgtttcaaaaattatttttattgttacattccaaagaggacagaggaagaaaaaagccagttatccaataatggttagacctttcagaagaggcacccacaaccccagccctagttcaaagctgcacacattggagctcaaacagctgcctctcaccacgaccggaaatgctgacaaatgtgtatatattatcaatccagggaggcttgggtttaaaataaaatttctttattgcaagtgtccaagtccttaggatttgtccttaaaggtactagaagatgagtaagaccacacacaccaagactatgtttagtctttagagtaaactagcaaatggccagtttgttctaggatgcattgcatcagacatcacagtacatgaagaaaatctgctttttgtgaaaagccaccaggcattttagatcccgtttaccatgaagtgcagacacagcagatacccagataatacagtcagtgcaaaagtcaaatgagtaagtcagctctttgatgaggctggctacactgcaaaatataaatgaaactcgaaaatagaaggtaaggtctatttacaaaagtttgtttagtaaagtgacttgaaaaaagttgttaaccacttcccaggcatccctcccctctcccaccaaaacaaacaaacaaaaaacaacaacaacaaaaaccctgaaaattatcttgaaagtcaagttaaaactatgtgggtgaaaagagagtgcttgttccaggtaaaggacttcaagataatttacaggcagatttatttttattagtaaaagtcacaaataggaaaagacttattggctgactttgagctgtgtgcttttaaaaatgtctctattattacgttaacaagaaaaaaaaatcaagcaagtttttgcttccagttttgaatcttccagcaacagttggtgaaatcaacaaggtattaaaatgaaacccagcaaaacccagtcagttctttccagttgtctgcctgtttctttctagtcaccttgaattcaattcccaattagctgaggacaacatgccggtcaaagacagactttcgctgctcttggacttgaagcttccagcgctgctgtgcatattctaccttgttcagcacgttggctcgactgcgggagcgggctcagcacatcgtgtgcatttgcaaaaggctggtgatccccaatatcatcatcactctgtatcaactgtgcatgtccaaagaggcgcctcttcagtatgggctcaaccagagtaagatataccatgtacagaagtagaaggcccaaaatggagagataaattataatggtaaccttgattgtgacagagcttctttcttcatatttgcattcacagcgtagacagtatgcctctacatcaggcccccgcacaggcatgggctccacaacatga

SEQ ID NO: 1974 - DNA, 1161 bp, Homo sapiens
  ref <308>: DATABASE ACCESSION NUMBER: Contig1505
  ref <309>: DATABASE ENTRY DATE: 2001-06-18
tcatacacaagccggtgatactttattatataagagagttgtcaaaaggacagtttcatttctgtttcagaatccccacattccagtgatccatctgttgacacaattaacataaactatttgctgatatttactgagtgcttgcaatgtatcagagtcattaaataagatgcaacttctactgtgaaaactggaatcttcattaggacacagacttagaaaaggcccagtttcaaggattctgacttgcacagactgagcactcccatttccagaagttcgaatacctcctttcttatctcgggaatgtccatcattctcctcaacttctgatctctccagttccagtcaaaaaccagaaattttaaggggctcaaattaaggccaccttgtttaacaagttctttaattctccccggagttcctacacccaggtgcaccacacgcttctccagcaactttacctgcgcctggacctttatgtgctttgcaaataattttataactttgccgtctcctctgaatgctgtcatcgacctaatgagctccagggctcggacggccgagctgcagatgatcagcatcaggaccgatttcttctcactgtggttcttcctaagttttacccacttaggacaaatttcttttaggtatgaggaaagactgtgagtcaaatcattggccttgaggaaacaggagtctggcaggttcagttcttctaattcaatcaccaagcgtctgctgctataatagtccttcatcagcttctgtaggtcttcaggtaaccctggttttggttctgattttgcaagaacatcagtaattttcttctttcttcttttcctggtcttggtggtattctcttttctttcctttggttgtatcaaaaaacattctttaggctgtttggttttctctgaaggtacaggaactggaactgtctcctgctgcatcacttctgtgtctccttctccttcaccatctgatgcttctgggctgctgcctgctccagtcggctggttctcccaccactcgtctccgagatcgtctgccatttcagctcaggtctcgacgtgggcagaacatcacgggtaggcgaccagctgcggagaatcacgttgtctcaaagccaggcggccggcgtagctacacgcggagctc

SEQ ID NO: 1975 - DNA, 835 bp, Homo sapiens
  ref <308>: DATABASE ACCESSION NUMBER: Contig1540
  ref <309>: DATABASE ENTRY DATE: 2001-06-18
ctgaatattttattagggcaaaacaagatatttgcatgggatgcttcttaagtcatctcaagtagttccccttcagttcttaacatgcactctcaaaatcaacacacctaccccaacccaatactcatcgcttcacagtcatccagtaaagtacaaaataaaaataaaaaaatcatcatctggcaaaaaagggaaacagggtaagagagagtgacattttaacacattactaaaatgtttaagcttttatttacacatccccttctctcagtttcccaggttatatgaacattacagcaatagaaaggggttatcatcacagcatccccttgcaaattccagtttacaggtaacttggtcaggggaaaaatatgggtcaacgaagtaagatctcagctctcccataagctattgctctcttcttctctttcccccttctcttaatgttagctgcctgttacagagagggatcatcaagactgtgtggacatgctagctgaattgacagggtgggttccagtgtcctgtgaagaaccagcaaggatgctttttataattccaaccattggcttcacatcactgaggtaacaagacttaatgttaagggtaaagacaccacgccaccctagtcagtgacatgtactccactttccaggaagacctgggccaaatgaccaagctttgcaaaagaaacctgggaagagcgttggaaaaagcagactctgagttggcttgagtctcctcgtgcatagaagcattcactcatccatgcagatggcaacaaggcaggacactcagaaagcataagatcaaggtactgctcttatctgcacct

SEQ ID NO: 1976 - DNA, 1153 bp, Homo sapiens
  ref <308>: DATABASE ACCESSION NUMBER: Contig1584
  ref <309>: DATABASE ENTRY DATE: 2001-06-18
aatgcacggtgaaaaatacattttaatccaaaagttttgaatattggcacttagaaagttatttacaatcaattttactataccctttgtgaataaagagataattatgtacgtgtagctacctatagttgtttctttccaactcaaacaccataactatgtggaaaaagggtaagagttaaagctgctgcagctcaaaatcattacaatcaacttagattctgcaaattttcccagggttgaaaaatgctggttaaatcaggacaaaagaggaggcaagtgagtacaccccactcctctcccattttacgtgttgctcccttacttaaccggcaaagacctgcacctgaattctagacaatttcatatacaacaggcctcttattatgggtccatagcagatggtttagggtagatgttttaaagatatcaatgctaatggcctaccaatgactttcatgacctcccaatattcgttttaatggtagtcaagagactatcaagcaggaagcctgatctcgacatgtttcctctgcggctttggtgaagctgactatctgcagtataaaatcttatggtttgatcgaagtctcatttttgactagaaacagtaaagagcagctttattaagatcaatggaatggttctgaatgcctgtttctacagaaggattaaattaaaattttttcttttttttcttttttgagacagtcttgctctatcacccaggctggagtgcagtggcacgatctcggcttactgcaatctccacctcccgagttcaagcaattctcctgcctcagcctcccgagtagctgggattacaggcatgcaccataacacccaactaatttttgtatatttagtagagacagggtttcatcatgttggccaggctggtcctgaactcctgacctcaagtgatccatccactcaggcctcccaaagtgccgggattacaggcatgagcaccgcacgtggcctagatgaaagtttttaaaagcctgggctaataaaatcatccaccaatcatttttcttatggttaaagcagccaaaaagctgtcacagcatttttgagatgagaacataaggcttgtgtggctttatgatagatgctgttagtcattttatttgattaagcccttggtcag

SEQ ID NO: 1977 - DNA, 1359 bp, Homo sapiens
  ref <308>: DATABASE ACCESSION NUMBER: Contig1632
  ref <309>: DATABASE ENTRY DATE: 2001-06-18
aaaggcaaaaaagtaactttattgactgctaatcttaccatgaaatatctataagaaataattacaaaataatgcaggtttctttttacatacttttggtatcatcttgatatgatgatcctttcacagaaaggattatttacagtttatgtagatataaagctcactgttgcatatacaaatgtagatgtgcagaggcaatatataccaaaacgggtatactgacaagcgatagatatgtaagaaatgcagaataaataacagctttatatatttcctttcctttttatttttaaaaacaatttccaaatacaaaacatggattattcaaagtggatttttcctatacatatatataattctgctgcaaacagtggatcaaaaagcagaagtgttcttagcatgattcatctttgaaaacccatagaactattcataaatccaattagaaagaacatgtgcaaaaccaccaacaatgtcagcaaaacctcaaagatctgattttggttgaagtagagagaaaataaacataaagcagtacctgtttacagtaattaaatatgttttttctttatctttctttcttaaatatgtctttttttaaatgtttgcaagaaactctaagggctaaggaaatgcactgcattatgatctgggctccttagagtacaaacctcaccaggcttaagcatcatccataagaaatggtggattacttaatgacttataagtaaaacagtcattaaatgatcctttcatactttaatcctcttatgcagagactgagatacttccatacattccaatatctgcaactttggttctattaaagtatttgataaaagcaaaacaattttgtgaccacagaactctatggaactttttttccttttaaagtgtcaggtgaacctagcgtgataaggcaatgttgcctacacatccgcgacccagcacaggagggacagcacagacagggcatgttccagctcaccatttgttgtataatactgactcccagccaggggtaacactgcttatgttccactgtaccctacatctatttcgttacctgaaaacataattttgtataaaaatatgattgtttctttagaaaataatatatagtttttttaataaaactgggcagatagaaaaaaatggtatatcaaaatatggtaaacaaatgttgtaaaatactaaatcattaaaaatatcttatagaaagacattgtgctatgaagttctctcctgaagtgtgaactacgtttttactttacatcaaaagattgataaattcactcccctgacttggtttcattatatattgtaacagcagcacaacaggtaactgtcttaaaa

SEQ ID NO: 1978 - DNA, 1389 bp, Homo sapiens
  ref <308>: DATABASE ACCESSION NUMBER: Contig1682
  ref <309>: DATABASE ENTRY DATE: 2001-06-18
tgaaaggtaagtaccattttatttagtgttgtaggaaatgttgggttacttcttaaaaacgaaaccaaagaaattcaaaagtcccaaagaaagaaagcaggaaataataattctataatccaaaaacgttgggcgatccttcagttggaggaagagggcgtcagttaagtagctcacacagtagatatggagacaccatatggagatacggagttaagtttggtggatactaggaattaagttctccacctaaggcaattaatttttcagccttgagagataattagtagttctagaaaaagaaaaaaagttgactgggagaagggtgggagggaggatggtgcgtcatttaacattaaattgcctctctctacagtatgtggctgagcatcatggaccttcctccctctgccccgttgagctcccactgttagcaaaactgagaagcacatgcctgtgtcttcttcataccggcatgtgcacacacacctgtatctccttcatacaggcatatgcagagccctcaccaatcggggtccacagctgttcagtatggcaaagggcagacttactccttcatccactctgctgccttgatgaggtgaacacactggaataagatggagggcaggatacctgccaaagcctgaggaatgagatgatctgaaacaattgggcaaaggctggacatttcaaaaagctgacttccaactgcagtttatgggtatagaatttgatgcttccctcaagtcctgactgctctttctgaggcagccaggctaggccaagaaatgagctgctccagcttctccagagcacagcagcctcccagggcctgtcagaatctgcagcagctggaaggaggtcccagctcttctgagacataggccatttgtaggattctccagtgctccaattcactaatgtctcctaatggctcagaacaggctaaagcttctcccagataacccctcccccaaaactgagtcctcagggacagttgttaactgaatgacctccaggttatctactttgggaggtgcaggaatgctataaactgaattttttcccagcagcagcagaagccaggcacccttgagtcaattgtccttcattgtccagagctaccaagtggcatttcagagcacaggaatttactcctccacccagatgtccctctcatatggactgagtcacacaccccaggtcctagcagcagacatctccaaaccaacatccttgtgaacactgcagatctctacgccagctctccaatggaagaagaaccacatagagcacacctcgcccccagggcacttggactatcacagtaaaaatacatttatatcaagtaaaaaacataatgcaggacaaatatatacatgtacc

SEQ ID NO: 1979 - DNA, 1365 bp, Homo sapiens
  ref <308>: DATABASE ACCESSION NUMBER: Contig1778
  ref <309>: DATABASE ENTRY DATE: 2001-06-18
tttaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaggctctgctactccccatttactcgctgcaatgaaaactggtaagccaagggtaaagcttaagtatcagggactatgaatttagggtagaagtgaaaataaccaaagtggaactaaatcccctattctggagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaaactaggacaaaaatctagcaaatggtttccctcg

SEQ ID NO: 1980 - DNA, 645 bp, Homo sapiens
  ref <308>: DATABASE ACCESSION NUMBER: Contig1826
  ref <309>: DATABASE ENTRY DATE: 2001-06-18
aggttaaattacttcgaaactttaattacagatacttttccacgcaacatttctgaaatgaaagctttgattctcccctttttttgcataaaggctgggaaggtggtttggccagaccgtacatctttttgtatatacatatctacacctgtgtctcttctttattaataaaaggtgtcttgatcacagtcccaaaccaactctgcattggattccagcatataaaactcagagagtaaaacaatttcaaaggaagacaggctgcaaccacaggaaaatggcaggaaaagttgtagcttgatagttgtttcttctaagtttaactcagaaatataataataattaagagaaaaaaataagaggccctagctttcatccctgctaccaaacacgctcgtccagaactctaggctgtcttaaagtgcaattactgttgtgaagttgctcaggccagggatcaggctggacggagttcaaagcagaaacttcaaacactccttgctgttcatgactcaggggctgggagggagggagaggagaaaaagaaggacagttctctggcattcaagtgcatcaaaagaataaatgtcttttcttttggtaaagcaaatctgtcaatagtaaggaatcctggtttggaaaaat

SEQ ID NO: 1981 - DNA, 1077 bp, Homo sapiens
  ref <308>: DATABASE ACCESSION NUMBER: Contig1829
  ref <309>: DATABASE ENTRY DATE: 2001-06-18
gcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccattagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactggaa

SEQ ID NO: 1982 - DNA, 992 bp, Homo sapiens
  ref <308>: DATABASE ACCESSION NUMBER: Contig1838
  ref <309>: DATABASE ENTRY DATE: 2001-06-18
cattttgaaaaatgtttatttaccttaccttttcttggccaagtcaattgctttggtcatctgcacaaagattctaaacactggctttcagcatttctttttccaagcaaatgaaatttatcataacaagacagagctctgattttagtctctgtggagtctgggctctgatgacctaggctagtcatcatctaagcctggaatgactgtttgggacccccatggccagcttgaagctttccttcctcagccactctgggcccctgaagaggtcacatgcatctgtggcagagactgtattataacaaagttgtttaccccaaagtcagcaaacacatgtacctagaactcatcccaattgtaggttgctcaccagacaggttacacgatgtgcaccagttaacatgccataggaaaattacattccaagaaaaagcaaaatgctataaaaacaaaaaaaacaaaacacccaaaacagctctccctcctttgatctgatggtctgcagaggtcctcaaatccacacactgccactcttcaagaccaaccactgggccttcttaatctcatccaaagtcgcattcacaactttgacaggagcttgggttcttcatgtggcagctgcaaccatgtagtgtcttctcacttgcagaactctaacctcaagtctctcatgagtcccaaaattccaggaagcataaaaaaacagcaaagcacacgagtatacttccaaactttgaaaatacaataagatcacaggaacaaatatgaccacaaagcagcgtacgtactgtataggccatattcctttacgtgggacattaatgaaaagctgtcttttccaaactgaatgcgcctattaataaaaaaatacacctgaccatctaatgctgaagtcatccgccaggatggtactggaaattgagtggctaatgtggagaaaacgcaggcagaaaaacaggggagacaaaacgaaaggctctcttggtttg

SEQ ID NO: 1983 - DNA, 1155 bp, Homo sapiens
  ref <308>: DATABASE ACCESSION NUMBER: Contig1938
  ref <309>: DATABASE ENTRY DATE: 2001-06-18
agtatttataatcatttacttgtagcgaactgtttaaagttaacacttgtttaaatttttttacactatagcatttatgcaatggtttacagaattcatggagttatttttatcagtatgggaattaattaaaaccttgaatctttgttttgtctgcttctctgagcacaagcctggtcagctggtccctgcgggtcctaccagccagcttctctgtagggctctcggccgcgtccacctctgctctcccaccacaaggtcacaaactcccacgcagtcctgggtcaccccgcagctgctctggagacttggctctgggcgtctcgtggcccaagtgctccaagttggaagtttctgtgggcctcgtgtaggggatgccgtgctgggtgagcaaacctttcagccttttgatctcctttgagagttctttatgagccttcctgcagttttccagggtctcaaaccccaagctgtcaggacctccctccagctgggtgggttcattttcttctggggtctttaagtagccagcatcctcaaaaagtgtcctcagcaacttctcatggccctggggggtgatcagctcatcggccaggtcctgctctacctggtcccactgccgctgcaggcctctggcagggttgggtacactagcaaggcgtgggggtggcagacgaggggggtctcgaacgtcagcgcgtagacgcaggtgctcggctcggacacatgggccagccggttgctttttccacacgccagctccaccttgctctgccggctccgggaacggcaggcgtcaccgtccctcatccacatgcccgtgaaggtgttgttggcgatctcccactcgtgccagatgccgaggatcacactgtaggcgttccagcggaaggtctgctcgtgctgggtcacgttgtggaacgggcagaactcatacttgtacgtggactccaccaggctgaagcacttgcccgagagtcggaagagatgcacgggtccagacacgggtgaaggatccctcttggcctggaggcgactggcctgaggcaagaacgggttgttcaccccaaacgcgttgggctcctccaccaccttcatcttcgctgcacctgccggcgcgggcccgccggccaagagcccgaggagcaacaggag

SEQ ID NO: 1984 - DNA, 1081 bp, Homo sapiens
  ref <308>: DATABASE ACCESSION NUMBER: Contig1970
  ref <309>: DATABASE ENTRY DATE: 2001-06-18
aagtttcaacctttttattcaaagcagcttctcacaatgtataaatactgcatattagcacacatgaaaaatacaacttctaaggcacccagaaatgtgttcatacacgttacaggaccattcacaaagagagtgtacaatttgctctagacagtcaggatttgataaatcagaagattattatccctcagtactgcacccagtctcagtaaatatttacaacatggtgagaaggggtcagctgtaccttctttataattctatgaagtactcagacttacaaatattcagaactagttaaagactctcccatgataatctggcaaaataaaacaagtagcctaattttgcaaaggtctcggtggattttggtgtatgctacatccatgatcaaatccaaacactcctagggtgggctggataagtttttggtagcctgcttcattatcggaagtttggtaataagccttaccaatagaataccacttcttcagcatcaatcatttctcaactggtcaatggatcaatgattccatcatgaatgagaatggagagagaactgaagacaattcttctcacacctaacaggaattagaatgggtcaatgaagaacaaaaggaggcagacatttggaaagtgcaggatcctactgttcagtatagacatgtctgaaaaattcttaccctggaggttcatattcagatggaggagtctacactggccagataacctggaggagtaccaggcctccacttttatgatatggatacaggcttgggactacacagtagaaacaccaacctgagatagtgagcttcaattagaaactcatctttcagagccttttcaatatgacaacgaatccctctgtatggccagccagggggagcatgaggttggtggaagtcagcagtttctctgcaccatcaagcatgcacatatctgtctagatgtgcccacaatctatgaaactcaggctttgttagaataatggaattctttggttctcggttttatgaaaggcaatattgtcacaatcctgtcaacatcgacactggcaaatgacttcaagctgggacta

SEQ ID NO: 1985 - DNA, 631 bp, Homo sapiens
  ref <308>: DATABASE ACCESSION NUMBER: Contig1998
  ref <309>: DATABASE ENTRY DATE: 2001-06-18
gccacctagagatgataatttattgttttaccatgactcagaagagaaacaacataaagagaatatttcaaatccccacaatttccttcctcaacctcactactcttaacatttctttatcagacgccactggcttcctaaaatggaccactgactatgtatgtgtacacatttcattatgctgccttttctcttatgattaaaactttagccctcattcgaggtttccaatggttacttttagtggaggagttccctagcttttaaaaaaccacttttcctctaagattccattatttattgaaagaagtctttctagaaatgttaaggaggattttaaatgaacacattcaattaaaaaaaaaatcacgtattgaacatctaccaagcatctggactcttcggaacctagtaaaatgaaaaaatccagttttaacaacagtaacttcattctgcgggtatacagagacaagcacgtttcttcttttggtctaatttattctaaacgaagaagctgggaactgacaaaacaggacaggttgtttttaatccagtctacaaataaacaagacaatgcctgagttagccctctatatagatttaggcttatgctgacctcgttgtaaaatct

SEQ ID NO: 1986 - DNA, 608 bp, Homo sapiens
  ref <308>: DATABASE ACCESSION NUMBER: Contig2099
  ref <309>: DATABASE ENTRY DATE: 2001-06-18
gctttttaaaatttattttaaaacatgaaacccaagctgaatagaaaccacagaaattacattgacgagatttttagtatttgccaagaaaaaaagcccccaaagaaataaaaatcagcccccaaacccagttctaaaaaaacaaaaaaacacagcgacagtacatacagccatggccctacagaggctggaggagggggaaatgcaaaatggttcaggcctcagttcctggatgttaaatcacactggggtgggggaggtcagatgcccaggccgggggggtaaaccaggaggctgagtcttaaggagattatatatatatatattatatataacaaatatgaagtggttcagtacacaaccattatggttaaacacaaaacaaagatcccacaggagaggccctggtcccccgcctgcccccttgtctggggttctggggtccagggggctgcctcaccacccctctcagggctggggcagagctggccccagggcaggagcaaatgttgcttggaactcgaattgcatagtgagatgggtgggtgggcaatgggccaggggctgctcccaaccaggcccattcactaccaaccttgccatgacat

SEQ ID NO: 1987 - DNA, 785 bp, Homo sapiens
  ref <308>: DATABASE ACCESSION NUMBER: Contig2143
  ref <309>: DATABASE ENTRY DATE: 2001-06-18
agtgtaaacattcacatatttaatagtacctttaaaataagcattactacatttaaaatggttccaaaatgaatctataaatggtaatataaattaaaaaatacgaacttaaagtgaataaatttttaaccttagctatggtataaataatggtaaatgtatagtgtacctttgagtcattaaaatgtcttaaaagataacagcttgttaccagaacattagaaaccatagccatgattctcaagcgttaacaatctacatttgatattttcttggccactgcattcttcaatgaataataatttccagaattccattccatgttgttttccaatagatcttttcacactcgatgttgaatacatggctctttgcagatgaataaaacaagtgcattcagtttagagatccattttgcgaaggctcattcgactgaaggaatctctgtggcaggtgacaggcaatactgccttgtataactgagggatctttctgttgatcagtggctgtagggcctctttaaggcgatgatagtttctctccagttccctttgatactccttttgatccggcccaattaagctcttattttttcttaaggcatcttcacaccttttagtaaaatctttaaagcagagtcgcagtttattatgatgtctgaagagctttgggtcactaggtatttcagacagaaaaacctgggcaacttccaaaggcccctgattcactgtggtgcctacagatccctggagtaccatctgaagcattttggggtctgcgggatc

SEQ ID NO: 1988 - DNA, 622 bp, Homo sapiens
  Modified_base 1 ... 622: n = a,c,g, or t
  ref <308>: DATABASE ACCESSION NUMBER: Contig2237
  ref <309>: DATABASE ENTRY DATE: 2001-06-18
ttagtttcaatagcatattttattttaatctaagaacaatgattaaattcaaaggtcagaaatataaaagattatccaaaaagtttaggatcataactgtttcttaaacaacattggcatgtacttgagctggttctgtggctccaaaggcttgatttttaccttgcacagtttaaataagcaagaagccttacgcgatgctccacaagcatcacaacatcacaaaatcattctacaaggcatgtctcaggggatttggggccatgaagatctttttccaaccaaaagtctgagccgagatagaatcacagcttgaagttcctgctctcagactgtcctccaaatggttccttaagacactgggtgccctgagctctggggcccaggcctgagggtggcagctggttatgcacgcagaccagttctgttggtcactgtgtgggcattccactcctatccttctctgccagtgccactcggatgaatttcccattggcaagttctcgtacccttgatgcattcagaaaagcagaaaggaaccgtggngaccctcaggcacctccccccggctgccaacaccagccccggggacccacgtatccggctgtaccttcagtaagga

SEQ ID NO: 1989 - DNA, 1170 bp, Homo sapiens
  ref <308>: DATABASE ACCESSION NUMBER: Contig2399
  ref <309>: DATABASE ENTRY DATE: 2001-06-18
aatgtttcaacaacatttatacatctttttaattagattagctttacaagcaacttgagagctctttcataatgaaacactgcttttcaaattacatgactttatagtctatctgtatatgaatcctgaaaatctttgcctactcttgataaaggtctgtgttttacagctggttaatgtgttgaataaaaacagcattatgaagctttatctttaaccaggattaaacacatataggccacaaacagttttaaattttgtttgaaatagagtcctgcttggtgacaagttaatagtcccactaacatgaaatgaatggatattaaataaatggccatcctgatttcttgatcttttcacaatgattcctaagagagtatataaacttttccaaaaaatatacaatttaagacctgtctggcaagcacaacccacagatagtagaatctaatactttttacaactgtagaggtacacatttgaatgacaacaggggctcccaaattaaaaggctgtggctgtacattttgacaatcaaacaaacctcccatcaacataaaacaatttctactaaccctaaaaaagataatgcttttgagttgtggcctaacgccgcgcactgtactatagaccagatggcaaagacaacttgcgctcctgggttgggctggcagaggcacttactgtagagatgtgatgttatcatctggaaggaaggggaggaagtagaacaaaactgaatatgggcgaggaaaaaacaataaactatcactttctcctgcaaattctcctaagtgagatcactatactgaacattcaatcccatcctaagtccactgttggcttcactacacaattttttttccatgttttacatgaatagcaatggcaatcttttaataaaaattactgagcttcccatagaaaaggtctcaaattgaatacaaactatacagatgctaaaaatgtcttaagttgaaatatacagaaaatttctgtatactcacattttggcaaagaagatcaaggacagagatagaaaacctaagtgggcaaggtcttacacccataattcacgcaaaatatggataccaccctttaggttttgctaaaaagcctaggaaagtgaagtctaagacatccgtcccaattcattctttcctcgtgccg

SEQ ID NO: 1990 - DNA, 874 bp, Homo sapiens
  ref <308>: DATABASE ACCESSION NUMBER: Contig2429
  ref <309>: DATABASE ENTRY DATE: 2001-06-18
ttaggattttactttagttttaattgacgttttgctcaaaagcaaagaactgaacatttcaatggttcaatgttacaagattacaaacaaaatccttacacagttacagtatcctacttcggttacttcacattaaatgcaggttgttaaaatcagtgctgtgcttgaacacaagataagcatttcaatttaataacaaaattaaatctagcaccttgaaataaatattgacgacagctttataagtatgaaagtatcatttcaataggaggaaaaaatccagttcaccaacagtggaaactaatagcagcattttcaaagctgagatgaaatttgtgtaaacacacactggcccgcacagtggacatgcacttctgttggctgggcctccccacccagggatgaacagagtgcccactgagccttttacattccaaatctggaaagctgcctcaagtttcagaccgtgggctagaaagactcaaatgcagggcaagggagatcaatgtgtttaagcaggatggggtcctttttgtaacaggccaacctagtaacatttccagtccaacttcagagcattccaggccaaaggtgcatatagtaacaggtctacctgatgtgaccctgacttcagggggagcacctgagtgcagggcaggatgcaggtgaggaacgagggcccaagatccccacagctgacaccactttgcaaccagcgcattctaggctaactcaggtgagattaaaaaaaaaaatctgtgattcttaacccactgtaaccaaatggttcttaaatagggaatgtctgcatggtaagtctccttcttaataacattttcaagcattaatgatgagttctttacagtgtggttct

SEQ ID NO: 1991 - DNA, 1055 bp, Homo sapiens
  ref <308>: DATABASE ACCESSION NUMBER: Contig2504
  ref <309>: DATABASE ENTRY DATE: 2001-06-18
caaatacaagactttgtttattaataaagtaattcattatgacttttgaaaaaaaaagttttaaaatgttctgtgtacatgtcaatgtaggttaggccagccaaaagacaaagcaaagcatcaacattaagtcacaggctaggattatacaaataagaacaaacacaaggcttatggtacttgttaggtaaacacaaccaaactaaactgtacttcaaatttgtttatataaaagcatattaaagctcactttaaaatagtgtccatcttttcttttaaacgggcatagactcatttgcagtcatgtacaaatatacctaatagctttcttcatcttttaatacaagtacaattccttgcttctttatgcaacctaacaaaataatatagaatgaagtcattagaaaaatatgaacctttctgaatctatattacatttttaatttaaattggaaaatacagtttagatcatatgaaacatatggatttcagacatgtattatctgtttctaacagattattacaggcggtctttattttggctgaaatgcaaaaatatgactttcttaataacagattagttaaaaatactttccattgatagcagtgctagtccctagaacaaaaggtaagcaaaacttatttgtaagttactgcctattcaatgcccagaatatgtagatcctaaatctaagcccttaatatacatctactttaaagataactgaaagatctcacatgcctgataatccttaatttaaaccgtcctgtaaacatagtcaaaatctgctaatagaaatacaattcaagtaaacattgcatatttgatttaaaccaccttacagttaaattcactcatgacacattggatcataaccactaatatgtaaaaagttttaaaaaaatcatccttacgtatagatgaaaataaactttgtaaacttgttcatttaaaataacgaatgtactgcagctgctcttgtggtttggcatagtttcaggtactgaatattcaagtaaatttgttcccaggtaaaccaagtctcctaatttgt

SEQ ID NO: 1992 - DNA, 1530 bp, Homo sapiens
  ref <308>: DATABASE ACCESSION NUMBER: Contig2512
  ref <309>: DATABASE ENTRY DATE: 2001-06-18
atactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccgttggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctggggcgcagggttattggggttccaggaacacagcctgatgatgcctccttacgatccaggatggagagcagcccccccaggagtatggggagggtcactgtggcacgggcttctccatgacctgggacatgacctgggacacatagtcaagagcacggttatcagcaatacagatattaataaaaggcagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcg

SEQ ID NO: 1993 - DNA, 724 bp, Homo sapiens
  ref <308>: DATABASE ACCESSION NUMBER: Contig2575
  ref <309>: DATABASE ENTRY DATE: 2001-06-18
tctgaagaagcatttattagcatgcagggcccatgctagaggctccttatttccagggcaaggccagcgagacagagcccattgctcaggacgcagcccagattgcaaagagaggacagcccatggtagcggaagaaattctggcggagagcactgtacttggggtccttctctcgcagctggcggtagggatcgggaccctggtggctgcctggtacctccccacccaggcctcgctccttctccacggtttgcagggcccacatggcagctgtggtgcggggttccagccagcgggcgttgacagtggccagcgtaaggctcaggaacagcaggtaaagctggctggcctcccagaatgtgagctgagcccaagcatgctgtgaagccaagatgcagaggttgatgaaggcacagcccatggagatgtggaagtagaaggggaagagtttgctctgcactagtccgaaggtatgtcggggaaggcttcggaaaagcaggaagcctgagacgaaggtcacccacatttgcatgccccaggcacctgacaagaccagtagatggaccatcttaatcaggcctcctaggttcccgccttcctccatcttgcagtccgttaggaaccgggacctcaatccgcagcacccggattccgagaacagaggcgtcggggccaaatgggctgaatctggtacctcactcccacgcccccggtgggacagcg

SEQ ID NO: 1994 - DNA, 785 bp, Homo sapiens
  ref <308>: DATABASE ACCESSION NUMBER: Contig2578
  ref <309>: DATABASE ENTRY DATE: 2001-06-18
gagctttggacaaatttattgaaacatacaggcggctgttagcagagaaatcattccatgattgatgtgttacatttggccactaccttgaatgtataatttaaaaattatatttttcacaactaagcctttggccaaaaaagtcatttagcacatctttaaagatcaataagaaatggattttggacattaaaaagatcaagtcactgaattaaacagtagcaacccccattaatctagaatcccatagtgctgaaggtagaggtgtctgtgcaaagctagtcatttgttaacagcaatcagaagagatgggggcaggcacacctgtcagaggtggcagcagagctggcaggacaggacggctgggctggtctggtcaggtgagcatgtcccagagacagcagcaacagagagccgtccagcaggctgtgaggcaggtggatggtcctagctcatctcttctttggtcttctaccacatacactgtggttttaggaggctcctgaggtccaccctgccagccgtactgtgggtatccttggtaggggtacccttgaggaggtgggtagggtccccccataggtcctggacccattggttgtggtggataaggtgggtatggggccgttggaccagggcctggatatggtggagggttctcttggttcatcggggacctgtaaagtgcacctctcctctccacgaaccgactggataacggtcgggtctgaacctgaggagcccggaccagcccgcagtagacttgccgcacctgtctcagattg

SEQ ID NO: 1995 - DNA, 819 bp, Homo sapiens
  ref <308>: DATABASE ACCESSION NUMBER: Contig2639
  ref <309>: DATABASE ENTRY DATE: 2001-06-18
aaattgaatttatactttattaaaatcaaacaatacaagccttaaaatttgattcaataacattataaaactatgcatcctttatgaagtttcagttgatatctgattaaaaaacactttgtttcataagtgttcagtgatttatgaaacttttaaaacaaattaagatgggatttattacatcttatagccattattggacccattctacattttgaaagactaagagaatagggttagctatgggaaatgctggctcactggaagaatcctgcattttccaacttccccactcctagaagttttgctaacaggaattgcaactaggaatgcctcacctgaaaaactaatttcatacaactttcattaagtagtttgacaatctgtgacccacaaatacttccatagaatggtagaattatttataatcagaaatgatggtggggtataaagggaatcaagagaggagagaagagggctaatgttgtttcttcacctctccccatgagaaaaatcatgtgaaattgttgcaagacccatgaaaggaattcatatataatatttctgtaccataaaataatatgattctatttgagaaaaaatcatagtacctgagtgcaaacagtattcactggcttattataatcaatttgcatgactaatatttctgtttgttttctactcaggtgacatatttgttcgataatggagggacagtcttctttgctatttttatggcaatatggggtaagtactttcttcattactttctatcccttattttctgaagctgtttctgtgttacacacacacacacac

SEQ ID NO: 1996 - DNA, 795 bp, Homo sapiens
  ref <308>: DATABASE ACCESSION NUMBER: Contig2647
  ref <309>: DATABASE ENTRY DATE: 2001-06-18
caggattcttttgttttattgataacagaaactgtgcataattacagatttgatgaggaatctgcaaataataaagaatgtgtctattgccagcaaaatacaattattccatgccctctcaacatacaaatatagagttcttcacaccagatggctctggtgtaacaaagccattttagatgtttaattgtgcttctacaaaaccttcagagcatgaggtagtttcctttacctacgatattttccacatttccattattacacttttagtgagctaaaatccttttaacatagcctgcggatgatctttcacaaaagccaagcctcatttacaaagggtttatttctttctactcaatttttcttaaaaagaatttcaagaatcactacacagctaagatatctgagacttgcaatggctggagtctatcagtacaatagtaattgcaatcagattcagatacaagagaacaggttctaacaatttcataattaagttgatattctgtttctatctataagctcacatttaaaaactacttcctcgaactacttatttttcctcagccacaagtaagcgcaaatccttaaaaacagtgggttgagccccagctccatgtattaggtagctaggtatattgtgggattattccttgttaagtcaccccaggaaacatttgcagaatttagaaatgcatccagatttgtgagtttatttttaagacctgactaaaaatctgcactcttcaaaaacttattgatgaagtacaaattgaggcagaaatttacattcct

SEQ ID NO: 1997 - DNA, 1005 bp, Homo sapiens
  ref <308>: DATABASE ACCESSION NUMBER: Contig2657
  ref <309>: DATABASE ENTRY DATE: 2001-06-18
aaacactttatttataaaaaagtacatttttaatcctcagtacattttcaacccatcatttttttttaatacaagtaaaagggggtgatgcaaacaccccccaggtcagaaccaggaggatctgctgggctgtccctggaccaaaggcggaaagggcgacaagacgccgaagcaaggtagcgcatcacgctgggaggggagggtggcagcttctcctggattcttttcatttatacaaaaaaggaaaaccaattttttcgaccaagaatcccattcctcacagcaggggtcagaagagcagcagcaccgagtgggacaggggctcctcctggcctcacaagctgggcagtgttggcagcagtggcagcagcagaggggcctgcctcctggcatccccggtactgggcagtgtgtgaagcctccctgtgggtgtggggacctggggcacacccacctgcccctcactaggagagggtttctgttggcagtcaggctttgggggtctctgtctggactcctgaggcctgggagcactaccctcctcccagaagaggggacatccgtgtctgcttggctcagcagagctgcccacacccacctaacacaattcccaatttctctgctctgaggaaggcagaaaagttattgcaccagtgacttgggcaagtgggggttggctggcagaggaagcgcatgcccaggaaacagggcccctataaggctctcttgcagcccgggcactgggaaattcgtttctccttaatggctttcagcaggatcagaccattccctctgccacatctgtgctgagtggccatctggctgtgcatgcatgcgtgtgtacatgcgtgtacacatgcctgcgcgtgggtgtgttggaggtgtgagtgtgtccactgtgggcacacgtactgggtctgaggtggtcgcacttgcaggcctgtgttcacctactctgtgctgctgcttttcagacccttctgataaaaggggactcggctggtt

SEQ ID NO: 1998 - DNA, 916 bp, Homo sapiens
  ref <308>: DATABASE ACCESSION NUMBER: Contig2728
  ref <309>: DATABASE ENTRY DATE: 2001-06-18
tttttttcaagtattactatctttattatggtatacagcagtattttatacattagctcattttatagtaaaaacatttatgcacaactgtagagaaactgctgcacagatagctccaacttaaattagaaaatattttctttgtagaaaatagtaaaaattataacatttaccaagctaacccaacaagttcatttaaaccaaaaagtagctaaatacattatacatttataaatacaggttgaattctgggatccaggagaaactttagtcctttattgaaatagccatgttttaagttatgtgaagtgaaatttctattaatcttctctcttactcttaatttatgccagattatttttctttaggctaaatccataatccacaacaaggttttagctgttcttttctaaaggacgggtaccatatccttttaatctgcttgataaggtacccatgcctatccaaataatgaaatggttcagttattattaaagcatgcccagtatttgggcaaaaccagaatctaataaattacactgtcacctaatacccatggcttgatgggaagccatcgaggaacaatgggtaaagtgataaaactggcaagtggatcaagggaataaaagcccaagagaattctgagaccagagggcaagaaatatctagtcgggattcaaggacagaactgaagttcaaatagaaaaagaatgttgcctcaaggattaggagctgagctggctatcagagctcctagtacatggtgatcaaataaggggcagttagagataaagactggattaagcaagagaaatcaggaccaagaaagattctaggtattcacaataattaaatgaaaacaagacagaccatgcagctttaaatttcctagcatagtagttccaggattctcagt

SEQ ID NO: 1999 - DNA, 1010 bp, Homo sapiens
  ref <308>: DATABASE ACCESSION NUMBER: Contig2745
  ref <309>: DATABASE ENTRY DATE: 2001-06-18
cctttcaaatcagcttaatcaaagtttattttcacaatgctacagaggtaagtccccaaactttacaatcctcatttgtttctctcaaaaagatctctttttttaaaaaaaaggctttagaataccacaccatgtttaaaatcctgtaagctatttttgaaatctaaattaaattctgacaatgataaaatgtttgccagccaatcaaagtcccaaactaattaacattcaaagtaaaaaagaatcatcattgggatctcattatattttgatagctgtaaaggctgattgactcctgtcattaatagtgttagtgtcataagcaaataatatcacttatattctagaaaaggaaataagcatatttgtcttgcacatcttatacactgaggtataaaaccatgttttaccaactttttttattaatgtaccaaataatttcttccacaatggcaactgtggtaaaaacccccatagcattagccaacctgctggcatgttctatggtcttctaattaatatagtgcacagacatttataaactacacagccacagtaatttacaagtaactaataaatattgaaatgctgggaatataacaaaactacattctaaatagtttactttccctttttccttatattattacttttatattcattcttcccactcatttttttcactagactctattaaattcaagatttaaatatggctaagcgtaagacaaaagagatgagcgtcaacaacacagctgaattttatcagtgtctaagccacttaaagctattctccacaagataagttattcaacccaaggcaaacagagaaagttggaattgaatcctaggttctttatatttttaactgtcaggtccacaggaacatccaaggctcaagttttgaatgtctacatgtcatgaagttaactatggcactagtggaatgtcgattactgaagatgaacccctagacacattcagcaagacattcaacttgcagaaggcag

SEQ ID NO: 2000 - DNA, 1771 bp, Homo sapiens
  ref <308>: DATABASE ACCESSION NUMBER: Contig2811
  ref <309>: DATABASE ENTRY DATE: 2001-06-18
tagattttcatctgtttatttttagagagatcttgtacttaactcactagtctgggatgttttatttatgtcacctaatattaactattgctaaatttcactttaataaaaaagtagatacaaagactcattttacttagcaagactgcaaataaaactaagacataaattcacatgttagtattgtccaaaacaattcctccagctatcaacccacggcaatcaatccagcagtatcatttatagaatgattactaaaacaagaatcatttctcagttacaaatggggtcattaagcccttggggctctttgaaagtagaagtagtttgcctacttaatcatcagtctacacaaaggcagaaataaaaaggaatggaaatacaaacacaaaatgattggttattacctgttttataaggaaacaagaaaaaaaaaacagtggctagaaacaacaaaaaagcagtggctggaaccctactgaatagagcttaaagaagtactggttacattcacagacacagtagccactagccaagatatagtttatctccatcaaacttaaatagataaagtcagtaagtatgaccatcttactttcactatttacgctctttaaatagtaaaggtatcggtttgaaagatacatagaaccataggaacagtgaatgatcatttataaaacagctccttttcctgaatcaatatattgctaaaattctttcagtaaccctccctttttatatgatcacagatccctccacatctattttattttagttatataaaaattattaataaactttggtttccttgcattcggtccttatattttaaaaagtgattaaaaacagtactgaatatgaatcacttctgcaaagtttaatgagtgagaaacattcaaccaaggtgatttttccttggaaaaccctacaaaaactgaattttataaacagttacttattttgatagatgttccatttataaatagcagccattacttcactgtctacaaaattgcaggctgtcacattttacatgtttagaattcaaatgttttaagattagattttctagtaagagttaaaataaaaacaaagttacacagacaggttagttgtcctatgcaaataaaacagctgattttcatgattttgctatttagacagataagagacaaccattggattgacactaatgtgtaggataacatattttttgtttaaagaggaaatgatagaaacttggggtggggcagctgcagcaggacttgactctactgaggctcttctgtgctcatgggacaagctatcgcaggatgttagtaccggagaggccctcaagttaagacctgagcaaagtgtgctattcagagaagctgagctatccctgctcccggttctactgtggtgaattggtgttttctgaggtctaggcaacaagagctcagagtagaaggagtagacattttcgggaagtgggatgctgggcatgtcatgttgctctaacaagtgattaatagcacggaaatgggaggaagatgaatgtattttaaatggatactccctatgctagtcttgggaaatgaccttcttttcttgagacggagccttgctctattgcccaagctagagtgggatggcatgatcttggctcactgcaacctctgcctcccgagttcaagcaattctcctgcctcagcctcccaagtagctgggattacaggtgcctgacaccatgcccggctaatatttctatttttcgtagagatgg

SEQ ID NO: 2001 - DNA, 875 bp, Homo sapiens
  ref <308>: DATABASE ACCESSION NUMBER: Contig2873
  ref <309>: DATABASE ENTRY DATE: 2001-06-18
tgctatctgaaaaccatttattgcaacgacaaaactagaggttaattactttttattattgaattatattgtaaagtctacatctacaatttaatcaggaagaaatgctttgcatttacatcaaggacacatttattctaatggaataaaacagacacacacaaaagaccaagtacatgtttttaaaaaatgactacatgtttcacctggtcctatttttgctatttggaccatacttttaagtgaattgatcttacatacatgttaagtctgatttatctccccacatttttaaacactaaatgaagcttctcacaatttctaattataaacaaaaggctgaaaacagtatgggaaacaaagtttcaaaacaaagaaaagttgagtaaaaggtgccccctctatggctcatctgaaagaaacattttactcagagaggcaaacatttctgatctaggagtaagtttcccactcactttgcaaggacccactcattctgcagaaagacctacaagtctttctggtctcaattgcaaagtacgtgaaaatgtgtatgaaagatctaaaagctaaatattagaataaggctaattgaaatcaaaattgtgtgctggtctaaatatacatcttcggcttcttcctttttagtaagtatttttatttcagatgtatttaaaaataacttacatttttagtgtgctttatggtcaatgactgtaaagttgaaactcaaatgagtcagtttaaaatttttgtctcatttgattctattgaaattttaatcacctactactttaatcaagttattcatgaggtaagtttcagcttaaaaaaaaaaatcatccacaaagataaccatttcaagagtacacaaa

SEQ ID NO: 2002 - DNA, 810 bp, Homo sapiens
  ref <308>: DATABASE ACCESSION NUMBER: Contig2883
  ref <309>: DATABASE ENTRY DATE: 2001-06-18
atatttcaacactaattttagtaatgctttacataggagttcttataaaatatttacttaaaattcacaatttactagatgtagtcatatagatctaacacagcgcttagagacaaactttattggggccttaatggatttataggaatataaagttatacaacaagaacaggatgtcaccaaaagagttcactggttggctgctgcaggaccatctcacaggcattgtttgctttggtaagttcaccatgatccagggcatggccttaaatctcagaggtcttacaacccgatcttgcccatgtcttagaattcatcgaaattcaggaagtgaaatcgtgctgattacatcataagacttaaaaagcacaacttccaggttcaggacaccagaaaaagcagggtagcattgtaaataatcttcattgttttcaccaggtgaactattatatgaatgcaccagggaaatggagtcatactgcaatcactcaaagactggtttagggtgggagaaatttatttctctacttctccggaggaggagggtgcgacttcaggccggctgatgcaggaggaggtgcggagggtagagtggtactacctccgttgggagttccttccggataatcccaacgcggagcgaggaggcagcgcttttttggaggcttggcttcccgtgcgtttccaggtgggagagtggatctcccggaggcacaaggttggtctcccataaggattacagaaacgggtcgtcagttttctccggtgggcccctgcaaagccaagagacctgagatggcggcgagtccc

SEQ ID NO: 2003 - DNA, 828 bp, Homo sapiens
  ref <308>: DATABASE ACCESSION NUMBER: Contig2915
  ref <309>: DATABASE ENTRY DATE: 2001-06-18
ttaaaggtaaactcgtttactggttcagcacacaattctcatgatcattaatactctgacttgggcctagacttcgtcctaggctgaaaggttgattcaggtacaattaaattttctggttaaaaattgtcattgggttcaaatgatctatcatccctctagaaggcagcaccagcagagaagctataaatacactcacttcaaaactgagctttaggggtggttgtaccttaaccacacaccctacagccaagagaaattagcagttgagcaaagatacagaccaaatgcctctgggagatggactgaagcagctccaaagaaagctgtaaaaaagtgacaagaatttgttcttccactttgagactgttcgattcaaacatgagtccaaggcacgtatccttaagaggagatgctctgctgctgtctcatttgccagattatccttcagttccaggctttcaacaggatatgactggttcatgctccatgataggaaaggaattaaagtttgaagccagaatgaatggccacaatgcctgatgttagactttcgtaagtcaccttgtgaaagcctgcatcttctatcatgtccttgaactcttcctgagacggaaaccttcggatactctctacaaggtactgataggacttccagtctccagcgatgacctctcccaggacagggatgacctggaagctatatagatcataaagcctggatatgaggggattgttcacttggctaaattccagacagagaaaccgtcctcatggtttcagcacccgatgagcttcctggagtgcctgatcaatgtgtgtgacatt

SEQ ID NO: 2004 - DNA, 989 bp, Homo sapiens
  ref <308>: DATABASE ACCESSION NUMBER: Contig2928
  ref <309>: DATABASE ENTRY DATE: 2001-06-18
aaaagtatcaaataattttattatgaaagataagccatttattgaccattcacttttctaaaaaaacacaaatgtgagaataaaataaacatacctaagactcactggcccctccaggacaggaagcagccctggacagagagcctgcaaacgagtttccttatgcctaatgtctgaacttctcatacattctaggatttcatgtttcgttacaaaggaaaggaaactggctagaagattcatgtacaagaaggtcacaactttaaagctatctgacgctaatgacttgtacaatctggtttgcaaactctgagagacagtatcaaataagcactgtcaaagactactcccagctaatctttactgtcatttttctttgaaattgtctttgggactggctatgttctcactgtagcttccgtttatcccacagcacaaaccctaaagtccatgtgcagtctccatgttcaagtataaaagtctgtttcaggacaaccctgggttgctgtagtgtttctctctctgtagtgtctacttggtgtcatgcccttggacaggctggccaaatggcagcacaatgcagggggtgacacggtcaactctcccactgccgaacttgctcccctttcaatctggtcactgcccatggtcaaggttgaaatcttgagatcagtgacgaccttggcctatcttcagtctgaagttgcactcttatgtaaccgaatccatttcttcaccaaaaattagctttcaaaaggtgtctggcgtattcttaggaagtgtcctgagatggagctggagggtcctggacttcgggctctggagggggtgctggcacagctgcttttttctgggccgccaggaactcatgaattgctcgttctatttgtggcctgaagatgtggttaagttttggatccaccacctgagaaataatcctgtctactccagcttccaacatccctgactgaaccacactctgcctcaga

SEQ ID NO: 2005 - DNA, 1104 bp, Homo sapiens
  ref <308>: DATABASE ACCESSION NUMBER: Contig3024
  ref <309>: DATABASE ENTRY DATE: 2001-06-18
gcgtgtcgatctgggggacagtttaataaactgccacacaacacagctgagctccacacagccacatgaggatggggacagccattccttgggtttctgaataacgtatcaagtgagcagtgaatttcaatcaagcttgtacatcaggaccgtcttgccaaaacaacagttgcttttggctgctggaagctgtagcttttcaaaacgttcacacatttcaatgtatcgtcgatgtttttaaatagacttacagggagggtggcacacagcaaaggcccgcaggccctcgtagcaccgcagtccaggtaggatgctgggcggcggggggtggtggagggggttctatttacagtgtctgggctttgactccactaactgttggttttgttttctttcttaaaccttttccttcaagtctggaagcctgtggagggcctgtcaccttaaaggcaaggattccttgtttgcaccaggcagacaaatgtcaaaccacgaccccaggggctgcactaggcgtcgggcccagaagcccctggccatccagccccgactctttcatgcctctgcccctgatgaggggacccagggtaccctcaaggggacacagaagggaggctgcatcctagtccagtgtcaaagtgaggggggcgctgcaggagcctggacaggaccacctagcccagccagggacaggagggtgagaccacctggaacaaaggcacagaggctggagagaaggcggcatgttcccagactgcatgggctcggggtagggggatgcgaggtcagaactggcatagtggccaggatctcgggctctactccatgggcaggggggaacccctggggctgcatggggccatggggaaggcgggcgcaggagacaccggctgctgtccaaaggccccagtccagctgctcctctgccagcagaaggcagaggacaaggggctggcccaggtggcctcgtgggacggggggaaaggagggaccagcaaacccttcttgggatggctgaggacacaggggactccagcagaaagggaggcccctgggtgtgcaagacgggacgctgaccagcctgggcctcaccggccactaccc

SEQ ID NO: 2006 - DNA, 1247 bp, Homo sapiens
  ref <308>: DATABASE ACCESSION NUMBER: Contig3094
  ref <309>: DATABASE ENTRY DATE: 2001-06-18
gaagacaacctttactgcatgttgacgctgatttaggcaatagcttcctaaaaatcatgtataaagttagttagttagacatgaaatctcttccccaatgttgatacctgcccacaaaatattctcaccttcagagtataagaatcattcttaaagccaaatattcagttcaaggcacatacgtcatctgcagttgtaaatttgcatttaatatttcacaattcctgtaagagaggctagtcaggagggaaaccctcaagtttaaatccccacacttacttacttactgctcatccgtcactttcgctaagtgagattaataattcagtagctggtccagaacgcacagcttgggaacgcagaggcccaggcctcatgtaatttcccactcccgtaactgaacgtgctgacccatgttgatgtctgccttcatccaggtggcaaatcagacatgctacgctgcccccttcaaacgagttcctcgtgttaggggcaaaggtcacagccaaactctgccactgacagccagtgccttggcctggatcctctctgtggatgcaggcctacccctcctcagtccagcctcatctactagaccagcttggccattcacttttcggatgtctgtgagcacaggactgcagactgaactctcactcaagttcttccatttgccaagcccgaggccttttccggctaaccagccctctctgcgctgtcttgtctcctgactcccaccctcaccattcacagaccatcacgacacagaggatgccaagttcttttagtaattcaccagctccatgcagggacatcacagggctgccctccatgagcagaggaggagggctgcctggcagagcgtttcacactccaggttagccagaaagagcatcttcatttttgtttccacacaacacttctctgtgagcctgttggccaacaaagtggcggccgattgttggaggagccagccaaccatcttgtctaacttcagattcttcagggctagaatatgttcaccccagaggcttagatgaagcacatttgcggctactcgggcagatggtctcttgctggcctctcgctggagcagtgccctcaccaactgtctcacgtctggaggcactgactcgggcagtgcaggtagctgagcctcttggtagctgcggctttcaaggtgggccttgccctggccgtagaagggattgacaagcccgaagatttcataggcgatggctcccact

SEQ ID NO: 2007 - DNA, 700 bp, Homo sapiens
  ref <308>: DATABASE ACCESSION NUMBER: Contig3164
  ref <309>: DATABASE ENTRY DATE: 2001-06-18
taatttactaaagcagaacattttactccttgatgaatccataaaaatacagcacaactgtattcttacagtatgtacaaaatcttattttatccttttattttcacaggcaatgcataattaggttgtttttaaatgagatattatgtaaaattgatagcaataactgtcacacacctctattgccattgtagggtttttctctttctctgatacttttttgtgtgtgtttattcaacatttatcaataagaattttagtgcattcactaagagccaagcaccgacacatcctgatatgcttccatctaggacttttagctgcttaaaaacatttaacatgcttcttttcctccagcaaactcttttaaaaaaaaaatgaaactctttccttcaatgagattatttcagaagttgccagtcatcttggaacccaaactcagtaataagcaactgtggcaccacaagtggaaaccttttgatgatgggcccagtggtttcatggaatacacgggtttactgctataacccaagagactccagttgagacagtctggctcagaccacatgcatccacaactatgaacaggagtaatgcctggactcatacccagttctcttgttgactatatctttgccaaaggactactgactagttttaatggggccaagaacacaaatatgtatatttttcttataaa

SEQ ID NO: 2008 - DNA, 1519 bp, Homo sapiens
  ref <308>: DATABASE ACCESSION NUMBER: Contig3252
  ref <309>: DATABASE ENTRY DATE: 2001-06-18
caattccacttttatttcttcaaggattagctaaagacactgtcaggaccgagtatttaaaatgtgtttggaacagagacacacaattgggacagaggaaaaaaggattcatcttgtgagtcatcaaaagtgctttatttgtaaagcccggctcatgactggagtgtattgttagcactaggagataacagggcaaacgtcctcactctgtccaaatggtttatcaacagaaataaatgacagactgtttgttatagacaaaaataaaagcattctgtaaacttctaaaagcatacacagattggcccccaaggaaacagttactcaaataatgtatgtgtaccttatctttacttcagggtctcatggttgtggtcttgggtcaaaccacagtagaacttcacaacacaaaaactgatctgatgccagaattaatggtgcagggaaaaaccaaatcatagtatggattactttaaatacataaaagatgaatctgtacactacgtgacagtggtgttaacactggctgctgaggataccaaatctacataaaatgagtggacagtatacggagggcacgactgctggcttccaaagactctgtgaactagatccacatacacggggcacaactgcaatctggacagccctgaagtaaagttcctggaaaaggcagtacggcagggagatctgttgagttgcaagtaataattaaagggtcgatttttgtttgtttgttttcttttctgaaactgcccacaaaaatcatatcatgttttaaacaaggagtttcaaaggcatggctttagcgcagcatgtaagtggataacctactctaagcaagactaatatttaagctcaatgccttttggaaaatgcaggagagttggtagatacatgatctaggttggaaatttataacttgattaaaaacaatcagcacagtttagggcaatgaactttcataaaccagactggggcgaaatctctttttaaaaaaatcaatcattaggttgataaatgtacatttggaggaaaaaaaatccttttccttttattgtgaaagactgtctaccatgtactttgactaaaacactcacgtaaaaacatggctgcaggatacgtctcaaaatatgacaaacgttatttcacctatactgtgactttacatgtaaacttcaaaaatcacatgctgtacatcaaatttttagattcaaaagatatccctgttttcctaataatgtaaacagtaaaactgagggtttcagttaaagggataattcgtaacaaaatcccattgttgaaacaatggtcaaacataaacatcttataattcagatctgcattcggtaacaggagaattgagagttttgatgctttgctggttttcccacagtgggagatgtagataccattgccccaaactatgcacttttcaggtaagctttacttttattttgtagcattaattcctatattgcaacgtaagggtgaacaatgaagctccaggcaagaaaag

SEQ ID NO: 2009 - DNA, 722 bp, Homo sapiens
  ref <308>: DATABASE ACCESSION NUMBER: Contig3495
  ref <309>: DATABASE ENTRY DATE: 2001-06-18
ttgttccattagaagtattttattttaaagtacacttgaaattttaaatgtgtacaaattcagaggtttaaaaaacttcgaaagtcacagacacagaatttaggaagctgaaggctgagagtctcccttctcacttaatccatgctttattttgcattcctcacaggtaaggaggcagtgcctgttatgctgtggaccaaaaccagccccacggagctgatcttcaaaaaaatggaatttactctggcatactcctatgtatgatacctttccaaggccaaatcccaagagaccagcaagtgcaactttgggcaatgatccaaatctagaattagctgccaaataaccttggtagactagtccctgggtgacaagcatgcttacaagagaaaaaggcagagctctcttccagaaactttcttcctgacattctcgcataatctttgagatctctgctctgtggatgtgcagttttgattttggacaaaacaacaggctctgcttgcttggtggtggaaaatgggcatctttatcttggtttccacgagcagacgctgaagccatgatgactttgtgcttgctctccttccagttgtttatcctctgcttactccttgacccagtgtctgtgtggtctgggtcgcctccgaggccgagtccctcgttgccaagcccagcaggcctcgctcccccgtgactgcaccgccggcgcgctccagctt

SEQ ID NO: 2010 - DNA, 1690 bp, Homo sapiens
  ref <308>: DATABASE ACCESSION NUMBER: Contig3607
  ref <309>: DATABASE ENTRY DATE: 2001-06-18
gagcttccaaaataacttttattactatataaaagaagtcaagaaaaaatagatgcatatttttcctacaaaattataaaatattcaggatagttaatattttttccataaatgcgctaagataaaaagatagaaatctttttcacttaaggttttcgagtaccttgtaggaattaaagaataataatgttctttcttctacattttcctaaagacatagcagttacagtttcctgctggagttatctaaaaaaggacataccaagataaattttctatcatattgaaataaaattagcataaagctttacttctgtctttgtgcttttagattggcaactgtggtcaatcagtgctgcactggaatttccaactcagcaggggaaagaatctaattaaaaatgacacacactctgtattttgtcctttagaaaacagaaactgcttgtcgatatcccttaaaaagtgcaattgccttctttgtcatttctttgtaaagtctgagatgttgtttctaaacagcacagcttacatgaaaccacgcaagtaaaggaaagaaagtgctttagagggcaggttccatttgacacaagcagcacaggaagccgtacacttttgatgacagtaattcaaaaagtatattcatttgagtttctcaataaacgctttgagagaaaaggctttaatgttgattcagatgagtgttaaaataaagctttcttttctgaaattagattatggggtaaaccaagccagattatctctggagatgacagaagccataattattttgggaaatttcaatcactgttttggaattgatacctaaggctttcttctcccctattatttatgggctttttaatgagatatttttctcgggagatgcttaggtaggaaatatcagcttttgaaagataaaggtacaattatcattagaatcaaaagcccattaaataagagtctcaaacaaaggttttctagatatattttatatacgttgttttcataaagatagaaaagaaattcctataatatctgtaagattatcctcacattagcccacatgaaagataaaataaagggctgagatggggggtgcttaaatactttgcaacagtgctattctagtgccaaagccataattaacttttcactgataacctgtttcttagcctatacaaaaaggaatggccacctcaattctggcggcttagtcactatctaatcccttcctccaaaaaccctggaattttgtgttcctctatgtaatggaacatccaacttatcaaatgatgtgtgactatgcaactactccttctatggcaccaagactgtaccatgctccacccatactgaatttaattgtgctaccactttgtgccaggcagagggctgggtactggggatccttctggctctattaccaattttggaaatagaatttagtagagaagaagagaacagtgttgcagcaaggggatcttgaatggtttttcatgaagtttaagggatatgatggagtgtggcttgtattcagtctttggaagtaagtaccagttacctaaaaagaaatccactaagcaccaaaatgtttagtgtatttggtgtagagtttctacccacattaaaatgcttcagtttaaaattgaagggaaggcaaaaaaatcaaccaaaaaatgaaaagtat

SEQ ID NO: 2011 - DNA, 747 bp, Homo sapiens
  ref <308>: DATABASE ACCESSION NUMBER: Contig3659
  ref <309>: DATABASE ENTRY DATE: 2001-06-18
tgttttccaatactttatattttattatttttatgactaaagaaatctgtttttaggagaaaaatggacagatgaacaaaaaagaacagaaaaaatcacccagagataaccactgttaatcttttagtggacacagctttcagaattgttttctatactatattactaggtaagtatctttgtagttttacaaaaatgtactgatgccatatatttggttctgcaagttgtgttttttaattttacaatgcaccatcaacattttttccatgtaacagatgaacatttcctactgagaacactgcattgcagataggtcaaaaggctgctagcaacaggagggatgcctaaagtaaagtattaccgtaacgttaaagcacatggcctggtaaatgcctgccagggacactacacataaggaatgtcttcaatgtcccttcgtggggccctgcagccacccctgaattcccttggacctctagggtagaaggggtcctgtaaatttctttgcatccacaaaaacgcccccaatttctgtttgctttttctcttctcatcctgcaccttagccatattgtcaaattctcttatcatgtcctcattgctgaaattcatatcatgtatggcctctttatactccttgaggtaatgagccagccccttattagtttttcttttggatttcctgggtacatcatcctcagctggggcgctttcctgcagcccttgtttcactccctggctctc

SEQ ID NO: 2012 - DNA, 1514 bp, Homo sapiens
  ref <308>: DATABASE ACCESSION NUMBER: Contig3677
  ref <309>: DATABASE ENTRY DATE: 2001-06-18
tactacacagaagtttattgtgaaagtaaattaaacaaacaaacacacagtatggccaatggtggcaaaagcaatctggtagcttaaggcaagttttaatggagatgaatttagaaaagatgatgcaatgatgtaattttgtttaaatatagattatgaaaaaatatcaaattgcatcaataacttaatagaagtagttttcaaagcctgtactactggagaaaaagggctcatgatcttaatgccagcattaagacagacagaagcagcatggtgctaaatgacagaaaaatccagtatttacattaggatggtaacaggaacatttaagagcatttgatcttatttactggtggaccgaaagcccttagctagacaatagaggaaaatgtaccatcatcatgttatttaaaaaaatttaagtgcagaagtaaaaaaccaaggagctctgtaataaagtaacataaaacaccactgtaaggatcacttaaaaagcgattccctcaggggaaattagggcactgagtgtgtaaacatgtgagctgtacaacaccaaaaccaaccaaattcattcatagtacttatagttatgcaagatcagcatggcctttaatgacgcattattgtttgtaacaatttaaacacactcctttccatgcataacttcaaatatataacaaatacttttatttgatacaggatatctgtttatgaaataagacctatatacaatgaaagtaacacctccctcatcagtcaagtacagttatatgctttttaaatgcaatgaccttattcagacttcagtccattttctgaattgactgtgtcagtttttcaccctttaaaataatgccatttaatgataaaatacatttttcaaaaattcagaaatgtagtaacatttaataaatgtgaccatgaaaaatatttgtaaggaggtgccaaatgacttagcactgttttccacatctgtatctaaaaaaaaagttgcaatttgacagtaagcctatttaaaaaatattcttacattaattcatctcaaaaggttctattaatagtccttttgcaaaataccatatatataactgtgaacgttttttccagaattaatggaagaaaatgcatcctctgcacagatgaacattttctctctaaaactaatctttcatcacccagcatgtttttacaaaagcatgcaatataaaatacacataaaagcagctatcttaaacatgattttaatacaatattacctttgtagctgattcatcactgtctccagtttaatatgctgttacatacatgaagaagctccagtatcccttttctgattgactttttaaaaaaatccctgaataaaacagaagccagcctgtgacttctttaggcatttcagtagaagatcatctatggagaatatctccaaccaaactcatgattacagaacagaagctaaaacaatctagggcagagtacagagttaataccaatttaaaacttttatgtttaaa

SEQ ID NO: 2013 - DNA, 1344 bp, Homo sapiens
  ref <308>: DATABASE ACCESSION NUMBER: Contig3682
  ref <309>: DATABASE ENTRY DATE: 2001-06-18
agacaaagacatggttacttttttatttgaagaaaaaaaaaagtatgttttaataaatactgcggaaacattgaccaaacaaacatacacagtgacttcaacagtttaaaaaatgcaacaaaagttctgctttataacagttataacttattttctttttacaatatttaaatacagaaagcactcgccagctattttgtaatactgcccaaagcataatgctgcatcaatcaaagcatattatgttggtaaaatgtctgtattttatgggaaatgactggaatcgaattttcttgcagagacaagacaaagtgcttgtaagacatagaactgagtgttgtaattaccttaatctctcctgccacgatttaaggggagcacagcttcaacacttcaaaaacgaagcactatcatgggaaagaaagctcgttttcaacaagcgccaacaataaacaggtcagatctggtttcttctctgaaagaatctctaaaaggaactggtcaaaaatatctgtaaactattttaaatgcttattattttacgtaacaacagagaccaagtgctgaacacagaccttggctgcgtctgttccgtgaggttttagcaatgacactctagaaatgccctagtgttatgtcaggactgaaagtttatcatataatcttccactagggattctctaaagcttgggtaagtggcatcttctctcatcaatgttcatttaatgaaaagtgaaataaaccaacagattatcagatgctgtcagttttggagcttcaacccaaaataatagtccttttgctttgtatttttggtaacttaattccagacagctttactcacaaactgtgctttctgctactattctttccttcactcattaccttttctggtgaaaacagtaactaccttttttctctccttggatcattctatgacatcaaaccaagacaccttttatttgactttgcatttttatcaacgatggcaaaaaatcacacaacttctaaacagcgcacaaaaatattacattgagcaatttaccactttttaatgacaatcacaatgaagaacagaaccatcagactgaataaaaatcgacattttttttcctatttgatctatgcgatctttgtagtgctggtctacaaatcttgcaagattgcaaaggctttccttagaaccatcctactcagctatcttcaggaaggcaagatttcaaagcctcataaagtttgcctctggatatatcccatgggtcctgatacaatttcctttttaatgatgagctagaaagaaattagatcacatcctctagaaaactaaatgctaaggtcacagtg

SEQ ID NO: 2014 - DNA, 615 bp, Homo sapiens
  ref <308>: DATABASE ACCESSION NUMBER: Contig3734
  ref <309>: DATABASE ENTRY DATE: 2001-06-18
ttagccacatgaattaagcattttatttaattatcacggaccaccttaaatattactttacaaaattcaggcctatatttaaaataggtgtcctgataacttccaggatattattcggaacacccgtttccccaactacgataagtccattgccggatgctgaataaacttcgcccattaccacttggatttcttgatagtcttatgtttccatcatccatcgtaatgtgttcagctcagcttccatctggctcaaactgacggttctcggggtgctagggcacaagagcgacagagtagactcaagatggccacatgacacagacggctgaacaggcttcaccggagtccccgagtgcacggaacctttccccgagggcccacggcccacgcacgccggggttcagggtccagggctgcacgtggacgcccggcgacctaatgagcactcaagtccgcgcatgcttgtaaacttaagggtttccaaagccgcccccgacctaccaatatcctgactgcgctgccttttaggtaaggcagtaagtttcggcccaattatcattttaacttacgaaagacaactacgtactttcacctaatcccgacgcttcccga

SEQ ID NO: 2015 - DNA, 986 bp, Homo sapiens
  ref <308>: DATABASE ACCESSION NUMBER: Contig3834
  ref <309>: DATABASE ENTRY DATE: 2001-06-18
ttataacataatgggtttatatttaatatagtacttctcatcaggaggatgttactcagttaatataaagttttttttcaaaacattaaatctcttttccatgtcaatgtctatagtttttttttaacattaaatttttttccgcatttcagtattagatacactgaatacatttttctaaatgttttttccctagagataaaagttttcctttttgcctgactctctgatatctaaatataatattaacttgggagacaacaaaacaaaaatctaatttaaaagactcctcaacgattcaggaggcagtgattataaccgaacagtggtgatttcctaagattctgggcaagaacttccttcttcctatttcacatgctttgagagaattctaagattatgaaatattacttatgtaaatttcagccatcttacttctttgactacctaactagcaaattataggctgcatttttctgtgcattatttgttgtaaagaaaacatttttttttcaatttataaatgtatgtttgttgccatttcatggaaacaatgaaaaatgtgaaactcccttatttactgattcttggaacctttcacacaccaaagctcaggtttagcctctaaagcgcaaaggttttcagggtgaggtttgactcagtaggcctttcaaagtcacatctgtccatttctttttcgtgcatatacccccaagcaggcacaaatgcctgtaatgctgagaaccacacctaacaaaagggcgattgcatcaccggcttctactgcttccacaacaggcagcaccaaaagcagtgacatgaggactaaggacaactgtgttgaaactgaggtcatgatgttggaatcttgagggctgaaggttccaaagaaatggtatatatagaattctatctgacttgaaattttcccttcctggagctccggatgctgagattaagaggttccacgtgacacgaccttctag

SEQ ID NO: 2016 - DNA, 1234 bp, Homo sapiens
  ref <308>: DATABASE ACCESSION NUMBER: Contig3876
  ref <309>: DATABASE ENTRY DATE: 2001-06-18
tttacactccctcagacgctttattgtttacaaaacagatggatcccatagggaaggaacacaatcattatgctgacagcagcgaacagagaggggaagaaaaaaggtgagctttaaagtaatcgcaaatcactgcctatgcgaagaggctgcttccgggcacctgggctgtgactcaggtgctgacatgaatacatcagcaaggtctcaattcagccacagtcccaagtcccccaaccttcctgattgcatctctattttaaatgacccagcctggacatcaaggacaatgatctaggaggcgggtcaaggagacagccaggcaaagtcagaacagacttggggcttccaggctatgcccggtgacagctgagctcttcagaaatgcgtcacattcagcgttcacttccttcgcttcctccactacctatgacatagcgggggaaagagacaaccatgagagaggggtccctcctcgctgccctcctcgcagctgtgcttgagtttcaaagggggagaggtttgtgagggaccggcacagggacagccagagccggcaccctccggcccaccgtggcacccctgacgatcgcggggtggggtaggagtgagggtgggggtcggggtgaggtagtgctgtggggagggcactgtgaatgatggaaacgtcccttctcagcctgggtcgtgcctaacctgggtctcaaatcccactctgccttcaccctggagtacactccagcgaagccgaggcccagccaacgctcgtgaagtttccacagagaagagcctgcaaaactcccactggaagaggagaaataaaggccatggaaagaaaccccagggaagagacaggcctcgttcacagaccctaggcagggaataaaaaattcaagtcattcacagaagtcttgaaaggcatgaggatttctgacagttcctagaaaaaggcaacattttctttatctttgtatccattggccaagaacaccgacatgtgagacttgcttcaccagccgccaccgcttccttacaatctccgcactgctggagcgggctgggtaactacaggactgtgctctgtgtgataagatttggtgattccactttataagaaaggaaactgctttaattaaagcaggttaataattaaaacttcaaagtactcacagccacagaattttcttgaagggagaaagcggtcactggccatatgatgcggagatggttttat

SEQ ID NO: 2017 - DNA, 873 bp, Homo sapiens
  ref <308>: DATABASE ACCESSION NUMBER: Contig3902
  ref <309>: DATABASE ENTRY DATE: 2001-06-18
agcattttttaaatggctttattaaaggctacaagtataaaatatgactaagttacaagtcgtcagtaagaatttattacttttgaaaatgttaattaaagaaagggagacgcaaagaaagggaggctcttcctgaaatccacacaggggggtgcggctcagacgggtgacagacccccgctgttcccagtagggcagcacccccaaacccagggggccaagggaggggctcccagatgaaacagaggctggttgctgatttcttgggggaacttttgtaaaaatgaagacactgaatccttgagctgaatcccaggtgcagagactggggggaggtggagaatccaaaatcatgctcaggtttctcctgaaaagtgtgtattttctaaaaaataaatataaactcctggtttgagaaactccctcatgatgaatgggaggaaaatcatggcaaatggagagctaagaaaccatcttcgcatagactttgcccaaggtgtagaggaagatctgccggtcaggcaggatgaagacccacacatgagcctgtgtcctccaggtcgtcccttcttccaaaagcacagcaaagcaatacaacttgaggactccctccaagatttcctaatttttgattttacatttaatctcaggaggctataccattaagaaacattattagagttattgctgggtgctgggccccagacgatactaagtgaggcagaagctttcaataattcctacagccctcagcaccaagaagaacttggagggaatattgggcttgttgagaaagtgggaaagaaattagaatttctcccaatagaagaggcagatcaccttggcctactctctaggacacaggtctttctt

SEQ ID NO: 2018 - DNA, 942 bp, Homo sapiens
  ref <308>: DATABASE ACCESSION NUMBER: Contig3940
  ref <309>: DATABASE ENTRY DATE: 2001-06-18
gaggttattacacaaagaaaaagattttattgtcttcttagtcaatatccctggtgaaattagaggcatagcttgagactggtgacagtgcaacacagaccttcaggagctgctttgaggactggcctgcccagatgcctgctgttaagccagcagccccctcactccggcccctgccatcttgacagatggagctgccatggtttcagggacactcagcagggcatctgggttggtccctcccacatggaccttgtaaagttgctattcaggggaacctggtatcgtttcaggcaaaacacagaaccatattagcacttctaagccccctgccccggccgcctccctggaacatttgggcttgtcgcacattccaggagggagcaggagcacagctgcagccacagctgccaggaacaggcctgggctcccgccctgtgtggggggagggcagaggctgagggcttcctctgggggccctgagtaagctcaccctcaccccacctctctgacttcatccatccaaggccgcttggccaagagcccaggcagggtgaggggctgtctcccagaccaggcctgggctgcctagcagaggtgggggagggggagcttcaggcctagcccaactctccagaaaccaggggtagcctgctgagctctgaaatgccagaagtttaagaaaagagggaagggggcaagaggtggtggtggtagtggtactttgctatttaaaggtagaagaatgcaaggaagtaaaactttttttctccatttgttgtttggcgaccccattggagaattccaggaggcatgcaggatgacatcatgttttacaactgagaaatctcagtaattctgtaaaatggagtccctgcctgctccatgttcctgatggaagctgctttgtatttatgtgcttaaagctgtattttatgtcac

SEQ ID NO: 2019 - DNA, 401 bp, Homo sapiens
  ref <308>: DATABASE ACCESSION NUMBER: Contig4380
  ref <309>: DATABASE ENTRY DATE: 2001-06-18
tttaaagtcaaaattgtttttattgtcagtcacatatttagtataaaaagaaatgcagcaaatggctcagtgttgtatttttaaaaaaatccaggttgtgcaggttgttctatttacatatgggagaagagctgttcccacatcaggcacagcagctgcacttctccgatgcccctttgcagacgcagccctgggcacacttggcacagcccacggggcagcaggaacagcagctcttcttgcaggaggtgcatttgcactctttgcacttgcaggagccggcgcacgtgcaggagccaccagtggcgcaagagcagttggggtccatttcgagcaaaggggatgctggagctcacaccagtgagacgaacaagcagtcaggcagttggaaagcagaatgg

SEQ ID NO: 2020 - DNA, 1417 bp, Homo sapiens
  ref <308>: DATABASE ACCESSION NUMBER: Contig4388
  ref <309>: DATABASE ENTRY DATE: 2001-06-18
tttttttcagaagtaaaagatttttattgttctatagacacttctgaaaagagatctaattgagaaaatatacaaagcatttaagagtttcatccccagagactgactgaaggcgttacagccctcctctccaaggctcagggctgagaacggttagcatatcgaatgatcagtaaaaacatgcaaaagtgagaaggaaagggaaaaaggtgcattcccctaagctgagggggatggaatttcagaacagaggaggcagggtggacaagtaccaggtggctctccctttccctctgtgttatctttcaaaacagttccaagcttggagaaagcaatgagctccacctactcagcagaacccacggctcgtcccccgtggacgtgactgagcagtgaccttgcctgccccgttcctcagccgcccatcccactgccttgactgaggggaccctgcttgtgctcctggggggcaggactgggggtcctagctccttgcttctttggttccactcagagaacagttgtgcttgacggactcatccccactccccaaactccaagctcctgctggtgggctgaaggcactgacagagtccctgggacacccccaggtagccaccttctcttgtgctctggtgggtccctccctgggcacatcgtcccatcctcagctcaagccccaggtctaggaatagggacagtgaagaaagtgtaccctccaagaaaaagcttctgaggacttttctaattgtgcagatacttctgaagcccatgccgccccgaccccacagccccatccccttgccagggcctcacatgcccggctcccccaaccggtccttccccttggcgtgccggtgcagctgtgggcccaggctttggcaggcccagcttcaagacagtgggacacagaaaacactttgcagcatcgcctctccctccgccacacccaggtcagcagagatgggccccccaccgagagatcacagctctggtacagggaggtgggcagggttggagaggaatggagagacatgtcacctctatagaaacgcgtccaaagtacaagctaagcagggggaaggaggagggccagagagcagccggaaagaagaaaagaggaacacggcagggggttctgggggaggagggcctcacaccaccccgcagatgagcgtctccaccacgaaggtgttctcgaagtggcggatggcattgcagttcttggccccacgcttgttgatccgcctccgcgttgcccggcgccggagccggtaggtgtctttcccgttgcacaggtggtagatgaaggaccccagggcctccttgtcactgacatgctccgtgaccaccatctcctcctggatgatgtacgtctgcggcaggtagtccccctcttcacgttcatgaggagctc

SEQ ID NO: 2021 - DNA, 1301 bp, Homo sapiens
  ref <308>: DATABASE ACCESSION NUMBER: Contig4467
  ref <309>: DATABASE ENTRY DATE: 2001-06-18
tagcaatacaaaagataaatatttattcagaacaaaacttttaacaatcaattttacattctaagccacaaggaaatagcaaaacatatagcaaaggaaaagcaaacactaaaagaaaagcagtgtactgtcttttctactggataacacttagttggcccatgacctctcgcttggcctatctcccaagtacattttagagttaacagctcactcataattttgggttaaaatccatctttctcctgagaatcaggagttgcacatgagctccagctagctgcttctctagggttcgtagctattgaggctaaggtgcaaatgtaaacctttggtaggtttctttacacaggggcacccccatttctcactggtggcaatgaatggggaaggggtagggcctccaaaggacctggcacactgtaatccagaagtggtgccccagggagcaacgaatgcaccctggagtgtggtccttggtccgttccgtatctcccaagtattcagaagcccctccttaaaaaccttctctttctgctccctcctccaggtgatttctcagcattcctctgggctgatcattctggagagatcagactttctgggccctcaagtgttgaggaaattgttgtgaagtgtgagaggtagtggaatgagcaccgggcttggggtcaggggactctactataggctggctctggcaccagacagctatgtgattttcacccagtcatttaacctctttgggcctgtttcatctgctggaaaaccagggaattggtccaaaccaactctcaggttctttccagcaggaatattctagattccatgattctataaaaaatggcttctgagccaccaaaagagctgtcatgaagtccatgcatctttgtgccataagagacgcccttggccaccattcagagcttattgattcagattatatacacttctaacaacactggtttcacaaattctcagaccacgtagattaaaagcagcaaattaaatgagggaggggaagagctgcaaaaggtagacactctgatagaagccacagtcaacaatgttttcaattcagcaaacactgatggagtgcctaccacgtgttgggccccgtacctagtgctggggcataaagatgagcaaggcagcccaaagggtgaaaatccaggggaagaaaaggtatggggcggggagggcgggaggggggcaaggagagagagaaaaagtacaagaaacaaaacaaatacccaatagaaaaacgaaaataaaattttaaaagggaggggcaacacatc

SEQ ID NO: 2022 - DNA, 816 bp, Homo sapiens
  ref <308>: DATABASE ACCESSION NUMBER: Contig4595
  ref <309>: DATABASE ENTRY DATE: 2001-06-18
aagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacaa

SEQ ID NO: 2023 - DNA, 675 bp, Homo sapiens
  ref <308>: DATABASE ACCESSION NUMBER: Contig4949
  ref <309>: DATABASE ENTRY DATE: 2001-06-18
gactgaacgatttctaaactttatggaaaaagccaatgacaatcaattagccaaaaacgagacgccaaatcccatctcactccagcgccatgccctcttctcaaacgctcgccggctctaggacctctccaccagcacagttctcaggagtcctgctggtctcccagtgctgttctaagggtccacatgaaggcaggtcaggcgggactccccgggcaagcacttctgtacgcggaaagcacgaggcgcaggagccatggagagccggtcctttggagacaggaatacttaagaggattggcaaaccggagaaacgctgggagaggtgccccgcactgcggtggtaaggcagagtctcagttctcctcgggcttgtcggctggcggtccacaaggctgaagcatcttttccatcaagttgaagcggactcgcgctttgctctcattctccgcaatggcgaagtagttgagaaggtcgaagtggcccatgtaggagcagtacgagtcgcggtgttggttcaccagccactcccacttggtggtgtcggcgtggcccgtgccgatgtacttggactgcaggtgctccagctggctatggatggtgtagcggtcagtcatctcgccgctttccccttcgctctcaggtcagaggacgcaggtaacaactcgccgctct

SEQ ID NO: 2024 - DNA, 375 bp, Homo sapiens
  ref <308>: DATABASE ACCESSION NUMBER: Contig5348
  ref <309>: DATABASE ENTRY DATE: 2001-06-18
aactaggcaaaggctttatctttgttttaaactattttctggctaattaattgccaataaataactgtatataatcaataattaaaaagcagtgtccaagggtcttggaatttatagacttacattttatcatatataaaacaaaaattttaaaagcagttaaaattcttgaaattgtattattttttagaagctgaatcaattcagtttgcctcactgttggaagcttcatcaaaattctgaacaagatcaccacttccccaatagtaagtggtacttttccatccagcttctgccagtttccttaagcttgttgacaccaagctggtttaagacactgggtggcatttctgttagctgctttgtctcagcatg

SEQ ID NO: 2025 - DNA, 352 bp, Homo sapiens
  ref <308>: DATABASE ACCESSION NUMBER: Contig5403
  ref <309>: DATABASE ENTRY DATE: 2001-06-18
cacttaccacacagtctaatccaactgagcattcactagacctttttaaaaactgagaccaactaaaagacatggtacagacatcacctctcctactctcaattctcttaacccctggtgcaaggacaaaatcttttcctaatagggacatggttcctcttggaagaggagtgggaagtgaaagttagggtataaatggggcttcctggaacaaagctgatggcagagaggggtgggggagcctagagtccaggagtaatcagaaatcaattcagatcatctagagagtaggaaatcattacagaccagatgcaggagtcctggtctgcaaccaacgttcggaccctacaca

SEQ ID NO: 2026 - DNA, 340 bp, Homo sapiens
  ref <308>: DATABASE ACCESSION NUMBER: Contig5716
  ref <309>: DATABASE ENTRY DATE: 2001-06-18
gttcaataatagttttatttacttatttcactgttaacttggggataatattcaccacaaagttgcaggcatcattttatagtacagactacagacgattgactttttcaagattaaaaatgaacatggtttgtgacacacctgaaatgcctactgaggaagtgctggccacgaggtaataaaaaaaggtaaaattcagtgcctttggcaaagatgtggacactgttttagatgcgagtatgatacatgccctttgcttacaaagcaaatatacacccatctgtttttggactgcggtttctctatccaccagagagcatctttaaatgattcacagaca

SEQ ID NO: 2027 - DNA, 393 bp, Homo sapiens
  ref <308>: DATABASE ACCESSION NUMBER: Contig6118
  ref <309>: DATABASE ENTRY DATE: 2001-06-18
aattaaggctttcagacctaatctagccatgaccaaaggccaaactccacagctttgtacaactgaagctcagcagacctttctggactttctcccactgctcctgttctatagccagttgctgtgttcaccaaacttgcctgacccttcctcctcctgtgctttcactcactctcctcctattttaatactcatctccagcctgcagcaccccaggcagtacaccttcacatgaggaaaatttacccatctttctacgctgagttaaaattcttccttttatgaaacttccctgaagtctaccagcatgacattccttctctttcctaagtccctattgctcttctgcccatcccacacatttggcacctagtcacaagttgctttgtgata

SEQ ID NO: 2028 - DNA, 408 bp, Homo sapiens
  ref <308>: DATABASE ACCESSION NUMBER: Contig6164
  ref <309>: DATABASE ENTRY DATE: 2001-06-18
ggctcatttggtaagctaacaaactggaagaaaagaaccagttttaactaaacaactctaaaagatctcagaatttgaaaacttagagttatgaatagatttgattcacttagccccaaaactatcaaaagaagtatataaaatattaatagtcaccaaaaccattgagctatagaattccagatattgaaattctaaggaaatgttgttttagaatcaaatcatgtactaggctgaaattaaatcaaataccattactgagtattgttattaggataaacatctttccatactttggtgaaattggaaatactcttgcagaagtgttttcatctctcacccagaaaaagtaaataatgaccttcttccttcttccacttaatgtaatatcctacatttacatatatt

SEQ ID NO: 2029 - DNA, 385 bp, Homo sapiens
  ref <308>: DATABASE ACCESSION NUMBER: Contig6181
  ref <309>: DATABASE ENTRY DATE: 2001-06-18
atgttgaaaagtggggcccatcaatgcctccctacttgttgagtacccacggcactccagggcagttctgttttcagttgacaaagcccaggtccagacctgcaggtgggctctccaaaggtgacaggatgcgtccttatatgatccagtgctgtggcaccaaaggattatggccaccggatctcaatgacctgggatcaagtcccaaccccttaccaagtggacacccggagtaatcactcaacatattgtagcttacattcctatctataaaatggcaacagtagggataagctttttccctaccataggaatatcatgaggatcaagtgggataatttaatcggcacaggccacaagtactttgtagtcaaataatatttgt

SEQ ID NO: 2030 - DNA, 424 bp, Homo sapiens
  ref <308>: DATABASE ACCESSION NUMBER: Contig6514
  ref <309>: DATABASE ENTRY DATE: 2001-06-18
aatgagactgtgctattcactgttcttttaggaatctctggctccccacaaacactattttgtgaagacatgctccagaccactgtgtatgccaatatctctttctccccagagcactgctgacacccctacacaaattaatgtccccatctctactgatacatctgataggtacaaacgatgtgtccgtgatgactggtggggctcatgtaatccccacctaagaaaagtagaaagtgcaactttatcttttaggttaataagtgctgagagatggaggtttttccttctcattttgatggagatgcctagaaaacctcgcctgacactctttgtccaacgcaggatagagaacatagcaacagaaagggtgaggcaaaaggcatggctggtgaagaggcactgcatgttatcaggatgtggg

SEQ ID NO: 2031 - DNA, 385 bp, Homo sapiens
  ref <308>: DATABASE ACCESSION NUMBER: Contig6612
  ref <309>: DATABASE ENTRY DATE: 2001-06-18
gctctttctagaggcattcacggcaatcaagccttacagcctacctatttcttagccgtaatttggaatcatctgtcttctagcccataccttcaactgccaggtctgtaaggccctcaaggtgccgccacctatgcagtcaggctcctccatgccatgccttgcagtggcactccactcagcaaaatgatgttggggccatctacacagcaggggtggagtccatggagaaggggaagggctctgaggtgtgattacgaataaacacagtccacggggctgagcatgggagaatgggggtattccagacacaggaaatggccagagcacagtcaggcacaagaatgccgggtgaaatgggtgcagtcgtccagccggccagggc

SEQ ID NO: 2032 - DNA, 433 bp, Homo sapiens
  ref <308>: DATABASE ACCESSION NUMBER: Contig6881
  ref <309>: DATABASE ENTRY DATE: 2001-06-18
tcctttaaagcacaacagtttttagttttggtgaaatcccacttacctacattttctttttgcttgcacttcggtgtcacatcagcatgatgaggcctcacagggtggcaggggctggaggacgctctccccactctttccctgactgtagccagcacactccacggctcaggctggcagccagaagtcagtctcttctttttctatttgaaggtctctgttgagctatggctgatgtacaggaacctgcatgtcttcagatcgtacaacctgagggatgctggtacgtggctgtgtgcgtaaaaccaccctcctcgtcgagacggtcaaggtgcccgcacccctcctggagcctggggtcgtgcccctctgtaaaacgtgctcaagtctttcccagcttcacagcgcttccctggcccttccttcccttctt

SEQ ID NO: 2033 - DNA, 368 bp, Homo sapiens
  ref <308>: DATABASE ACCESSION NUMBER: Contig8165
  ref <309>: DATABASE ENTRY DATE: 2001-06-18
cagtcagaaaggccatttatttatgtttcaagatgctcactgcctcctttgttttgtctcctttgcaggccttctctcttaggcctcttctcctgggggtatggatcctggggggagattgatcacctccatgcttccattcctccccagccatagtggggacatcatgagagaagccaagccactggcccaggatcacccggcatttatggtggctgctctggcacaggtccttgcctttatagcccctccagtgatccataaggccctctttctccccaaaggagaggtcacagatagggcaaaggtagctcttctgcttccagtgggtctgctggtgtctgaccagcctggaaaatgagctgaaa

SEQ ID NO: 2034 - DNA, 368 bp, Homo sapiens
  ref <308>: DATABASE ACCESSION NUMBER: Contig8221
  ref <309>: DATABASE ENTRY DATE: 2001-06-18
aataaagcctttttggtttattgcacatcatataaaactgactgcactgtatttgaaacagacgaggacattcacaaggatggagaaaccaaggtttccttctttcctggccctcatcttcctccacactgctcctgaggctggaggcagctttaacccaaagaatggaatccgctagtgaacatgtttgttttgtggtggcatcagagttgttctgggcccttgtgcactgtccagtttggagactgctggtaacaatgacaagtgtccgggtagcacggctgggtcaggagaactgcatctgggctgtggcagtgcagggagcctcaggacacctggtctcaggctggcggtggctggggttggcc

SEQ ID NO: 2035 - DNA, 377 bp, Homo sapiens
  ref <308>: DATABASE ACCESSION NUMBER: Contig8347
  ref <309>: DATABASE ENTRY DATE: 2001-06-18
tcttttaaatataaggttactttaaaataattctttggttaaagtataattaaaataaaaagtagaaactcctccaagcctttcactacagagtgaaaaatacgcccctctttcagccatcagatggccatttaatcagccattcagattctatgaatctaaatgtaatggaaaacactgtaatctgaactccatactggggtgaagcaataagctcctagctaccaatgcagtgatggtgaagagagcctgggaaaatgaaacccccagcttatgcattaaaatgtgccaattactctggtccatggaggaacagacgcggtattttaaaatcacaggaaacaaagttctgtctgtgaataacactggggcattac

SEQ ID NO: 2036 - DNA, 465 bp, Homo sapiens
  ref <308>: DATABASE ACCESSION NUMBER: Contig8364
  ref <309>: DATABASE ENTRY DATE: 2001-06-18
atacatgctgagtttattgccatataagaaatcaagagtttcagaagaacacacaaaatatatacagtgaagaccttggcagggctgaggcaccagtgctgtgtacatcctctccccaaattctccagcagctaagaaggcacactatgagtgaaggcacagtaagagtcaaagctcccagttaactttctaggtatatagataacagtgaagactactctaaagactactctactaaaaaacagagctgtgagaaggatgaaggtgtctagattttctgtataagtagaactgtaataaatgtatgaggttctatttcaacaccattcccctttattaactttctatttgtatgcccttgaccaaagagtaatcttccaggctttggggcagaaggctgtcatggcatagagacggagtagggggacaccaccaaaacaagatcacattatcatgatcacaaaa

SEQ ID NO: 2037 - DNA, 351 bp, Homo sapiens
  ref <308>: DATABASE ACCESSION NUMBER: Contig8581
  ref <309>: DATABASE ENTRY DATE: 2001-06-18
ctatttttcaatgagtcacctcttcctatgaaattgaaaactggtcactttcagaagctattctgcctatcaatgtagcaataagtttttaaaaaagaacaagaaatccacttaagtaattaattggatagtaaattgtacatacagaaactagacaaatggaaaactgccatattcttttcagtagttagggtactggtctactggtacagactgataatatatactgtacactgtaaccacggcaacctgaagttcaactcttcgaatcccaagaaatgtaaaaattgttttttggatttaaaaacgttaagctgagaaagagtaacactttcaagttttcattttgtg

SEQ ID NO: 2038 - DNA, 391 bp, Homo sapiens
  ref <308>: DATABASE ACCESSION NUMBER: Contig8888
  ref <309>: DATABASE ENTRY DATE: 2001-06-18
atcagtgttctctcaagttggttgagatttattgctcgtcttgcaattttaccataattatcaccagtttagtttgcagttaagttactgacaatccctgcagttcagaatgacagaatttacatcaacacaaatctagtcatttaactagattttgaaactcctaatgatccaaatgagtaattcacacctattactgaagcagatgcacacataataaaaaaccatgtacctgtattgtatttcatgcctgcgactgttagtctcttgagtgcattttaattagacttcctttcccactagtgaaatccaacggtagtcaagtttaccactatcaggcctcatattacttaagtactttgcaacaggtaaccctgttgactacttcctc

SEQ ID NO: 2039 - DNA, 390 bp, Homo sapiens
  ref <308>: DATABASE ACCESSION NUMBER: Contig9259
  ref <309>: DATABASE ENTRY DATE: 2001-06-18
gtctttttgtgtacttccagcataggtttggatatatgaacatttttcttttattgttttatcttcacagaaaataaaaggtgttaatttgctttttaaaacaaatttaattatcacattttaaattactttgtggactgtgttttcaaaactttgcaaattcatctgttacacagaaaattttgacttaaaacatctgctgaattccaaatttctgtaatagctactgtatctgtgataaactttcctatatctttccttgccatttctatggattttataatgaaagaaaaaggcattggagactgaaggcagaaatggttgtgacagtgctgtttggctttttcattcttcaaatgccaagtcatccactttgttttcctgtttagg

SEQ ID NO: 2040 - DNA, 408 bp, Homo sapiens
  ref <308>: DATABASE ACCESSION NUMBER: Contig9541
  ref <309>: DATABASE ENTRY DATE: 2001-06-18
aacaaatctgcagtgacttttttatagtttccaattctatatggaaattttccatcttttatctccttgaatacagtaaacatacttaaagtctacctcacaatgcaattatttggtgcccctttggtctactgtttctgccagttttcattccgcctttctcctcctgtatccagggtatgtggagatactgtatttgaaaaagtacccaaataatttgaggcctaggaaaatattcttcctccaggtttctatctttcaggttcctaggggcattagaaacctaaggtcaccttagtccacttccaaaatctcacaatttactaatccaccttgatgatttaatgctaaactacactctatgtgaatggtctacttctgtttcaccattatccctaggatgctgtc

SEQ ID NO: 2041 - DNA, 393 bp, Homo sapiens
  ref <308>: DATABASE ACCESSION NUMBER: Contig10268
  ref <309>: DATABASE ENTRY DATE: 2001-06-18
ctttataggttatttaatcactaatctcaatgaatattttatctaaatttaggagacatagtagcttcattatttataacccagtagtcatgtttcaaaatcattattgcaattactttttgattctttacataattaaagctctaatattccatcttgcccagaaggtcactactaaaactcgagacaagataattgctgaaattttaggtgggtgcttaaggtacatcgagggtcctggtggtgaccctagccagagcatacctggcaggggaagtgttaccaccactgctgggagcaggggagccagaggcaaaaccagagtccaaatcctgggtgagtggccagatgctcagggcgccatcctctcgaagataaaggccagccctggag

SEQ ID NO: 2042 - DNA, 353 bp, Homo sapiens
  ref <308>: DATABASE ACCESSION NUMBER: Contig10363
  ref <309>: DATABASE ENTRY DATE: 2001-06-18
gcttttaggtatttcatgtttgatgcgtttggttccagatacttttgttttgttctcattttcctgtgaactgttctcctgtttccgaggtttgattggaggcaggggcttatcttcttctcctttaataaatctttcatatggtaggattaatctttcataatgtctgcgggtacaagtggcagcgctggtgctcccaggattaccgcctaattcatcataaatatgtttccactgacggcgggctgttattgtttcatatcctcccagtttttgagcagcttgaaacatagtccaaaggttaatctgtttaaaacctaaatagggtattcgttctatcggcgttttccttt

SEQ ID NO: 2043 - DNA, 388 bp, Homo sapiens
  ref <308>: DATABASE ACCESSION NUMBER: Contig10437
  ref <309>: DATABASE ENTRY DATE: 2001-06-18
agtctcctcaaagtttagccaacttgtctctggaataaaaagtgtaggatggatttacctggttcacttaatatgctttttggatgactatgaaaagattatctagtgtctacacttcctggaataagatgagaaccttatgtgttttccatgatcaaagtgtttaacaaaggtcaagttacttcccttgcacttcaaaaacaaaaaaaaatctagatactttggtgaattatttaatgtttttcactttatgtaatatcaaaaatgagttgggtgggggaaaatccattctttccatcatatcactcacctcaagacagactcagtcctgtcctttgttagcctccttttcaggatgattgtaacacatcacatcagtattcatagt

SEQ ID NO: 2044 - DNA, 371 bp, Homo sapiens
  ref <308>: DATABASE ACCESSION NUMBER: Contig10973
  ref <309>: DATABASE ENTRY DATE: 2001-06-18
ctataattagcctaacgttgaatttcacagatataaagatctaaattcaagttatgcaaacaactgatcaggcgaatagcaaggatgtaaagacaatggaaaaattttgagaatgccaaactctgtgtacacctggcacttccatctttcctgcaactttctgtcttccttcttcaatacagcattccagaaaaactcagcttgcacaccaggccgtctgggcattaatacctctctgcctttgctcatgctatttcctctgttgtgatgcctttctcctttccctgtgtctatctaaaccccagtccactcttcaaggaccattcccaagatgaaaacttccccaatgactccagtacacactgactggc

SEQ ID NO: 2045 - DNA, 353 bp, Homo sapiens
  ref <308>: DATABASE ACCESSION NUMBER: Contig11086
  ref <309>: DATABASE ENTRY DATE: 2001-06-18
tcacgcacacacatcaccccaaggtggacacacagagaagggtctgagaaggaactcatgtaaccaaatggaaccatgacataaccaaatagcacctcctctttttaagaggctggcagaggagcccctgcttggtgtcctcctcactggctctttcggagcccacctcacgcctcactagctagggggtcagcagccaccaggcagatggacagccccgtctccacactagaggaataaatgtcagcgacacgatgacagcagagaacggtcacataccaccttggaactggaaatataggaggaaagaaggctttttttgctgacaaaagaaaagtcactgtgataactgt

SEQ ID NO: 2046 - DNA, 397 bp, Homo sapiens
  ref <308>: DATABASE ACCESSION NUMBER: Contig11275
  ref <309>: DATABASE ENTRY DATE: 2001-06-18
aatagcaattcaaagattttctattccttagtacaaaatgtctgcgagtcaatccatttcctctttaaaatatttagacatggtgaatgtgaaagttctacccaaaaagctttaaagtttatatcatctacttccaacaataggatcaattagcattgaaagtctaaaaagtcttttaaaacaaaatattaattttaatgacaatcctaaaatcaactatgcctttaattttactaaatacacaaggtcaagaattacttttccattagattccactttaagaaattccaacaggaaatgacaattgctaggaattaccaaatttggcaaggtgttctttgaaaagtccacaataaagcaccatgttacaaagtttgataaaccaaaaaataatagt

SEQ ID NO: 2047 - DNA, 505 bp, Homo sapiens
  ref <308>: DATABASE ACCESSION NUMBER: Contig11648
  ref <309>: DATABASE ENTRY DATE: 2001-06-18
gcttttctagtaattcatttttattgttctttacaaaaacatctggctgtggtaggttgggagagcatggtgcctgccccggacattgtctgcgggacaccttcatcgttagggtcacagcgtccaggcttgctcaggacggtcttgggcgatgtctatcccgtgtagttagataggatccctgtccctctcaaaaagtgtcccaaaagtgggagtaagagttatatagtcactgtgactcagccagtgcaagagctggagctccttgaagcccacagattttcagtctcaggcatccttgtgtggttgccatggccaccaggtgtccaataataggccttgttctcccagctccggcccacggagtgtccataccttcccccaccaccctgcccgctgctgactgcagccagtgggggccctggggctgtcccaggcatgagcaaggtccttgggcgctgtcccaggcatgaacaggggctttgaggccgtcgccagcgtggtg

SEQ ID NO: 2048 - DNA, 463 bp, Homo sapiens
  ref <308>: DATABASE ACCESSION NUMBER: Contig12216
  ref <309>: DATABASE ENTRY DATE: 2001-06-18
aacaagttcctgtttcacttttccagctagctgctgggtatctccaacaaaatatctcatagatctctcaactgtaatgtattcaagccaaaaatcagctctgcccattctccatcccaaagcccctcctcttggttacctgttagtggagcaacatcatcccagtcaccaacacttggcaactgattcttccccagcatccagtccccatatctagacgattgctaagtcctctgatgctaccataataccttacacatcccacttcctctaccctgaatgcagtttgtattagttcctgcctagaattctacctaaactattacagcaccttacctactgctttcccttccccagtccttctgtctgatacagatctgccttcagatccatcttggtgcacattcctaaccaagtcacttcctggtgcaacagaatgagcatgggctttggaactaaacaa

SEQ ID NO: 2049 - DNA, 411 bp, Homo sapiens
  ref <308>: DATABASE ACCESSION NUMBER: Contig12369
  ref <309>: DATABASE ENTRY DATE: 2001-06-18
gtgctgggattccattttattgcaaattaaactcaaacccaggggtattaggaaaaggctagccctcgcccctctcactctctaactatcctccctccctccagatccccaggatttcatggccagggctgacaggagggaatgggaaacccatgggctctgaagggatgtgctccccagctctgatgaggcctaaactgcttcccccaggaggtaaataagccaacattcctgggttgggcctcgacgccagtccttggaggtggcaggtacagcactgtggttttgcagtctttggtcttaaaggtctgaggcaagggcaggggaggggtaggaacttggagagcaactggactttgaggaagaaaatatcagaacaaaaaaaaaatccagcccatctggggctttttt

SEQ ID NO: 2050 - DNA, 399 bp, Homo sapiens
  ref <308>: DATABASE ACCESSION NUMBER: Contig12814
  ref <309>: DATABASE ENTRY DATE: 2001-06-18
atggctatggataatggtcgtagatatcttacaatctaggattattttgaaaacttttttctgagttattcattgtaagactctccccaatccaagggtgaaggatacttggacacaacacaatgccagttcaagttcaagggaagtgttccatcctctttcagcctccactcagctccctgacacacggtgcatggtccagctccctgggattttcccattcggaaagggaagccgtttgtcgagccagcctctgtgaccactcatgatctgaattacccacaggtgttcgaaaatacagagggatccagcataattaagagcattaagcaatcatctcagcccaaggaggcagttgaagaaaagaacagagtttgggcaacacttggggaaataaat

SEQ ID NO: 2051 - DNA, 369 bp, Homo sapiens
  ref <308>: DATABASE ACCESSION NUMBER: Contig12951
  ref <309>: DATABASE ENTRY DATE: 2001-06-18
acaatatatgttttttattcttttcctagaacattttcttacataattaaatacaaaatgaggaactttcatatttctaggaagtaccacatacaatgatttccttaaaatagcttgctactaaagctagagtttagcagataccacttctttctacttttcaacattatactttatccttgctatccctcaccattctctcattgatctacacatgttcaaatgtaaagaaatcaccttagctttttcttaaaatacgtgatagtgaagagatgatacagttgccagaaagtatcaaaatcaagactgagaactggtatagtgggaataaaggccactgaagtaggcaactccacctcctcttgactt

SEQ ID NO: 2052 - DNA, 398 bp, Homo sapiens
  ref <308>: DATABASE ACCESSION NUMBER: Contig13480
  ref <309>: DATABASE ENTRY DATE: 2001-06-18
atggatgcaggtatggggatgctagccgtcctcttccacaccatacagacagcctgtcagtggcagagtaaggccagcatgcaaatagagcaaaggtatacaagccaagtaatatcaagacaaaagtcagggattattacactctgagatcatttgagactctagatttgtctcttaaaccaaaattagattgtgttagccaatgactacattttcccctcttaaactagattgagttgtattttgctacttgcaataagaagaatcctaatatacttatcaaattgccagtgttccaaatttaaaactttaatgatgataaagttcaagaaaatgacactctaaaatacaactaggtcaaactttctagaagataaacaggcaattacattgaaagc

SEQ ID NO: 2053 - DNA, 415 bp, Homo sapiens
  ref <308>: DATABASE ACCESSION NUMBER: Contig14284
  ref <309>: DATABASE ENTRY DATE: 2001-06-18
acttaaaaaaaagaagctccagaaaggaaactttgaagcaaaataaggactccctctccctccagaacataaagaatgaggtgtgttttgtttgagttggtggcaacatttaaactcttgtttatcccctaggaggtaaggagaagatattttccaattttcccaaacagggtgttatgaggtaaagttctgtgagagaaaggtgaggcccttaaatctgtcaaattattaactgatttttcttctacaggtggtgattttttgaatttcctatctttgtctttagcacccaattttagagaccaaatggttggtctaatcaaatagttattttgtgttatccagaatgacccctgcattccactctccagtaacttcctgaagcttttatcttgatgtaaaaacagggcagttt

SEQ ID NO: 2054 - DNA, 342 bp, Homo sapiens
  ref <308>: DATABASE ACCESSION NUMBER: Contig14390
  ref <309>: DATABASE ENTRY DATE: 2001-06-18
gctttttaatacaacatttatttatttaattgttttgagatggaggtcttgtcatgttacccaggctggacttgaacttctgggctgaacctcctgagtagctgggactacagatgcgtaccaccacacccggcccggcatgatataaacacttaaacaaaaattttaataaggattagtttttgttcatagggagaagggcccatgaggcgaagtgcctaggtttcataaaagtcataatggaagcccagggtgacagctgtcagccactgtgggctggggcaaggagaaaagcctatgggagcagcttcttccttaggggttggctgaggggaagagcat

SEQ ID NO: 2055 - DNA, 350 bp, Homo sapiens
  ref <308>: DATABASE ACCESSION NUMBER: Contig14780
  ref <309>: DATABASE ENTRY DATE: 2001-06-18
gaaatttgcattttaatcagcgtttggctaacaatatgagataaactattagagaagtgtaggtcattctggcaaatagaaagttccatcatttcacacttagaaagctgccacgaagagcttattcttggagtataaaatgcagaatttaggttaagccagtcattttgtagatgaaattgtacactggcaatttcttatggttcaacctaatagtaaaacatttataaacaattgtatcattacaaatacatttagacatcgttttctgctaaactcagtattttcctttccatcctgatcaaagaaacattattgcagtaagccacattataattcagcacgatttc

SEQ ID NO: 2056 - DNA, 480 bp, Homo sapiens
  ref <308>: DATABASE ACCESSION NUMBER: Contig14954
  ref <309>: DATABASE ENTRY DATE: 2001-06-18
gctgctacatattttcagctttattatttcccagtattaaatgcaatgattttctaaattcatggatgtaaaaactatgcaccgaacaagatgcaaatataaaaagtcttatatacccacacctagttcctccaaccatgtctcattgttttttaattccacccaaattgcttagtcaggaattatctcatttcacaaagaaataaatattttaaaacttctgggactccatattattttcacaaaagtctcagagttgaagagacaccaagaaacattgaaattccttcataacttcttctactttaagttttagggaaacaaatgagaacgccatcatttttgagaaaagcaaatcaattcctcctctttttctcaggaagaaagagatttttagtttggcctctttcactatttgtcagttaccaatgttaactccttccttcattaacagtttccatatcatcaaataaagcaaca

SEQ ID NO: 2057 - DNA, 386 bp, Homo sapiens
  ref <308>: DATABASE ACCESSION NUMBER: Contig14981
  ref <309>: DATABASE ENTRY DATE: 2001-06-18
caaattctcttttattgctttatgtccctgactcatgcaggccaaagggtgaggaggagtaatagccaacaagagcgtcctgcagaaagaaacaggctgcgtgggtccggaggagcttgaaaggaagaacccgaccaaagggcaggagacccggctctccaggtcgcggaggcgtgggtgcccagccaggcggagtgcggggcggggcctctcgggccgcaaggtggggcctcctgggccgggaggtgggaggtgagctccgccagcccagcccactgcagacaggttacccaggacctcaaggtgtgctgcgtcaccccgcccgcgctgcgctgattggttcctccagggagcccccgccccctcagctgtaaccgggccggctt

SEQ ID NO: 2058 - DNA, 384 bp, Homo sapiens
  ref <308>: DATABASE ACCESSION NUMBER: Contig15692
  ref <309>: DATABASE ENTRY DATE: 2001-06-18
ctcataatgtatctagcagtatattctaaaattcctgaaagtatagggtttttctggttatctctcgctattgattcctgaattaattgctttacggttaaagaagattatttctacgttactaatctaaaatttgttggcttgctttaagactctcataaatattccatgtgtgcagttgaaaagaatctgtatttcacaattatattatatatggtcattaagtaagcttgttggtaaattttctatgtctttatagacttctatgtttccttcattcatcagttccttagaaaggtgtatttagatctcccactatgatgatgtttgtcctctccaaacttcatgttgaaacttaatcccaaatgtggcagtattgaaaga

SEQ ID NO: 2059 - DNA, 422 bp, Homo sapiens
  ref <308>: DATABASE ACCESSION NUMBER: Contig16192
  ref <309>: DATABASE ENTRY DATE: 2001-06-18
gctggattaactattactgtattatttcctcttctcccctcttctgtggccttccattttaattattcataaatcctttcagaatattctcagggagatccataaggggaagttctggagatgtaaaatccaagggaggaagactggggattggaatgtccttggctttcccggcatttgctgcaaacttctgccaggttgaggaggctgtagcagtttctgaatgtggcggcaagctccgtaattctgacgtttctacaaaatcagcatctacatccagctccttttctactggacctttttagaagtctggccttttcagcctttagttattttctttccttaatctttcattctcagccacaaggaattccacacgtctcttcaaatctgcaattttggttgcctattcctctataatt

SEQ ID NO: 2060 - DNA, 369 bp, Homo sapiens
  ref <308>: DATABASE ACCESSION NUMBER: Contig16453
  ref <309>: DATABASE ENTRY DATE: 2001-06-18
tgggaaacatgttttatttttgccatttagctgtgaaatcatcaggatccagacataagatagtgtaattattctgcaaacacccagtggacagctcttgtgtcacccatagcacccgagggtggtcaaagtggctcattctggctcttccaagaaatgaatccaactggtgacaggggactcagagacaacttctcttctcctttcccacagggagacatctcctgcttccttttccagggcaacgtaggctgaatacatcccaaagtgctcagatgagctgcttggtggccacaggcttaactgggcctgggccagccaaggaccgaacccaggctgttgggagacagcttggactctgtttcatgc

SEQ ID NO: 2061 - DNA, 443 bp, Homo sapiens
  ref <308>: DATABASE ACCESSION NUMBER: Contig16759
  ref <309>: DATABASE ENTRY DATE: 2001-06-18
gccatcatcaacacttatttaaaaagtactttaaaatcattcattttctgaaaatgcttttcattattttccagggtccataaaaagcatagcacggggacgaaaagcttttctaagccagcagtgtttggtgaacactaacaatcccactggcataaagttaaagttttatttccttttttcttttcttcttaaaataaaattaaggctcaaatgttctattaagctctcattgcttatgtatattatattaaggcttataaatgcacctggtaaattaaattcaccctggattgaattaacacctgctatatgagttatttgctttatgtaatcagtaatctcaaggtttctcctctttctctggaaacacaatttaaatattaacctaatctttaaactgcggctgcttctttctgacatttggaaactggtcatccata

SEQ ID NO: 2062 - DNA, 352 bp, Homo sapiens
  ref <308>: DATABASE ACCESSION NUMBER: Contig16786
  ref <309>: DATABASE ENTRY DATE: 2001-06-18
ctggcttaaaccccaaatggccaagatcccagtctgaataaacaatgtgggtggtgacttttctgtgaggcccagtagaggatgcaatcactttcttattcggttcaacattaaatcatgtgaaactagcctgattactccacacaacttttactccgtaatggagggcaacacaacatgtattctttctctgcttctcagggagaaagaaatgaattctcctaactgggagtgtttaattatgtataaagttcgttgacctcacaggcggctgtcagatgatcttgctaaggcctgtgaacggcatcccaggaatgcagtgatgtgggcagaaaccgagtgagttcatgcc

SEQ ID NO: 2063 - DNA, 334 bp, Homo sapiens
  ref <308>: DATABASE ACCESSION NUMBER: Contig16905
  ref <309>: DATABASE ENTRY DATE: 2001-06-18
aacccaaaataactttattatcgtctccacttttgatataaaagcattctccaaatggggggcaaatgtggcaagtcactgtggagtctgggccccctgtacacccttctactccgaggaataagccctgtgcccaccccagttgcccattgccatgtcctgccaaccccctgccccccgccaggtcaagccacagtgcagtacagaagtgaaagcctgagattggccagacacggtgaccacagggcctcttcctgaccttggctgtgggggcagggggattgcacattgcagcttcttgctgtctccaggaaagactgagtaactggggggc

SEQ ID NO: 2064 - DNA, 378 bp, Homo sapiens
  ref <308>: DATABASE ACCESSION NUMBER: Contig17103
  ref <309>: DATABASE ENTRY DATE: 2001-06-18
acaatttattctaaaggtaaagatcaccctcctcatttcgcagaagagaaagctgaggccactcagcacccttgggccttaagccactgccaggatggtagccctgctggtttttactcccatcccctccctgcaaaccagcaaagaccacaggtagagctgctggggaatgctgagcacaggttgggagcagagggcacctgcctactggggaagccctgaaactacaaatgaggcaccttctctaagacaaatcacacacaaatagtcctagtgctgggatggggacatctggtaaacccccatcctgggtttgcacttctccctttgaccttgtgcctggggtacggacccaagccagactcactcttcatatgg

SEQ ID NO: 2065 - DNA, 342 bp, Homo sapiens
  ref <308>: DATABASE ACCESSION NUMBER: Contig17105
  ref <309>: DATABASE ENTRY DATE: 2001-06-18
tttattattttgaagtaaaatttatacatagtgaaacgcttacgtctttaacatactatttgaggagttttgacaaatatataaactcttgtcaatatataaactcttgtcaatatatagagtattccaccaccccaaaacatttcctaaagtctctacccattactgtctctactccacctggaaacgcagagaggcacagccctatctcttgcacccataaggacactcacagcatagactgggcgagggccagcatctatggactgactgcccatcagggagggcttaggcctcagccagctgctgcagcaacgagagagtcccatagagggcagacag

SEQ ID NO: 2066 - DNA, 438 bp, Homo sapiens
  ref <308>: DATABASE ACCESSION NUMBER: Contig17248
  ref <309>: DATABASE ENTRY DATE: 2001-06-18
cacatcataaaatatttattaataagtaaaatgattttcccctgcctttggttattaaaaaatgagtatcattgatgataccaattgccaacactggttttacattattcagtcatgaaacagaatagaaagatgatcgatagatatctatagacataaatgtgtagaagaccataccatacagcaatttgtttaattacaaaatactggttgtgctagcagttggaaatgtacttgcacatccttaaagttatctttttttatataagtaaagaacacacaaataaattcacttgaatttgataatttggaacattggcaatgaatacagtgcctgttgaggcctgaaagagagaggaaatcaagaacagtgtgggagaagaaaggcaatccttcgttgaaaagcttttctcttaacaatccttagtgcctgaaaaa

SEQ ID NO: 2067 - DNA, 334 bp, Homo sapiens
  ref <308>: DATABASE ACCESSION NUMBER: Contig17345
  ref <309>: DATABASE ENTRY DATE: 2001-06-18
cccatgctcccactggtttatttcaaccccaaatattttccaacagaagtagaaaacagggcatattaaacaaacaacaaaccaaccaaccaacaaaactaaaagtgatactgacacagttcaggtgataagcaggaaaatgggattatcagacaccggctctttggcacacactgcgaagtcagcccctctgcccagtctggaaaagcaacggcgtaagtcaatgtgatgaagaggtccagcctctcgtcgggaacttggccgcaaaatgggtaatgcttttctgtaggatgtggattgtagctggtgttgcaatggtgttttgctcagggct

SEQ ID NO: 2068 - DNA, 427 bp, Homo sapiens
  ref <308>: DATABASE ACCESSION NUMBER: Contig17359
  ref <309>: DATABASE ENTRY DATE: 2001-06-18
atttaaataacattttaatgacaaaatttgatgctctcaagtatcaaaatggaaataccaacagcaaggtttccagggatgtccaacaccacagagcagggaggcctggctgggcctccactgttgaggtcatcatggtgcttccgctttattctgattaacttttggttacacacattgaaaaatgacctaagagagttgttttgagtggcgctttttctcattgtacagctcctgctagcagtttactgcaacactgatttctctggaacctctcagtttccagtcatcattagggctgttactagcaaggacctacaagccagcctcaaaatgtgagagggctgccgacagtcttcctgtggttagctgccacagtgcccagggaccatcttccctctcctcctcccccactgccagctcctgt

SEQ ID NO: 2069 - DNA, 396 bp, Homo sapiens
  ref <308>: DATABASE ACCESSION NUMBER: Contig18502
  ref <309>: DATABASE ENTRY DATE: 2001-06-18
aaaaattatatttaatacaagtgaatagattagaagatctgaaatgttataaagcaatatacacaacgaataaataatttgcacaggagagtcatgtctacattacataacactgtctagtatgggaatacttaaagtaaatccagtgataatggagaaagtccataaaaatgctaacctgtcttcccttgtatgaaattgttcaagtataaaaatccaatacagtgtaaaatagtattcaatttagtttaagaataaaaattgcaagtattgcagtttcagaagaaaaatgtaaagcagcatttaaaaactacataatagtgttaaactaatgaattaccaataaatgaaatctacacaggcaaaatcagaggaggaagcatgaaactagcaata

SEQ ID NO: 2070 - DNA, 369 bp, Homo sapiens
  ref <308>: DATABASE ACCESSION NUMBER: Contig19551
  ref <309>: DATABASE ENTRY DATE: 2001-06-18
actttgccaccaaatctcagattattagaaactaggtgtcagggtttatcaagaaggccaggaaggccttttgggttaagccttacattcatgaagaacctcgagggtagatttttgagagcattccaaatgaatggtctctggtcaaatgaatgaatggtcaaatgaataaatctgccctcacagagatacaaaaggaaaaggaatataattcataccatttggtttaagccttacattcatgaagaacctcaagggtagatttttgagatcattccaaatgaagtcgaatctgccctcacagagacacaagaaaggaatataattcatacactattgcatttttaataaatcttttgaaatttgcag

SEQ ID NO: 2071 - DNA, 381 bp, Homo sapiens
  ref <308>: DATABASE ACCESSION NUMBER: Contig20156
  ref <309>: DATABASE ENTRY DATE: 2001-06-18
gtgaatgaggacgaagatactgctatcaaagccagccagcccagatgtgctgcactatcctctttctgtgagacgctgtgagcacctacagtcaacagattatttattaggcaagagaagcacttaattctaacttctggctagcaaagcatcctcctttccctattactggacaattactttctcagatcccctctttcaaattaatctttccctcatccatggtcctctctatcccagttgtcaccctccctgtcttctggcagtagacaacaatgcccttggacagtccacagcacaaacactggccggaatgcagtgctgagcgtacgtgggccgagcacatccaccgggctggctagcagggattgcttgttttca

SEQ ID NO: 2072 - DNA, 407 bp, Homo sapiens
  ref <308>: DATABASE ACCESSION NUMBER: Contig20217
  ref <309>: DATABASE ENTRY DATE: 2001-06-18
agtgttacagacagatattgtgaaatttttccttgggcttctttcaatttcgttcaattctcgtccagtattctcataacatttggatcaggtactttatcaccttgtagtgtcactgttcctttctgtatcctctcgaagcctcctgttactcgttttctaattctcttccagcccactgcacgatctagtgtcgaatggatgaaacagctgagcagaacagttctttagctgtcggcctaaatgaccaacttcatgacctctcaaggtctcgctccccggctgcacgcagctcagcttccaacattcgggaaaggcgtgccggatcgcgaggggccgctgggaccgagtccggacgtcgcgacgcgcagggggctgctgggccggcggtctcgggaaaagtgagg

SEQ ID NO: 2073 - DNA, 343 bp, Homo sapiens
  ref <308>: DATABASE ACCESSION NUMBER: Contig20302
  ref <309>: DATABASE ENTRY DATE: 2001-06-18
aaaaggggtttctctcatacatatggttctgcaacatttttgtattttagcaatacattgtgaacaactttgaaagtgaattcagacatcagcctccttttaaaaagctatactattcactggccagatttaccattctgctattaatgggttgtttcccaatgttctgtatccaccaacactgatgccataaatattctggcatgcaactcttcacacattaacatttgtagagtaaatattttaaagtgggtggggtggctggcccagggaccagcctgtaaacaccaaatctaattaccttctctcaggtcctccttggcctcaccctctacatttcatg

SEQ ID NO: 2074 - DNA, 399 bp, Homo sapiens
  ref <308>: DATABASE ACCESSION NUMBER: Contig20600
  ref <309>: DATABASE ENTRY DATE: 2001-06-18
agcaaaggtaccatttttcacaggctattttctactttcataatcatctcataaaggcagtataggttcaaaaggcaaatttttaggagacaacctgatcagccaccaagaatcgtttttgatttggtatcaaaagacataacatttgatcagtttgcaattttgtttgggataaatatccacagtgatactttgactctgaaaaaacatcaaagtgccgctttgggggagatcatgaaaacacagcacgcaggcctaagagttgctaggaaggctatgacagacgggacagcagcaggttctctctcaagactagaccgtcaacagagcatgcagagaaagaggcacagaggctgttgcttcacaaaactgaggacggtcaggatcagccaccaccac

SEQ ID NO: 2075 - DNA, 387 bp, Homo sapiens
  ref <308>: DATABASE ACCESSION NUMBER: Contig20617
  ref <309>: DATABASE ENTRY DATE: 2001-06-18
aacttttaatttctgatcgagtcacagaaggatttgttgagtagcttcagcacttcttcctttgtcatttttttctgtctgataagtcatgccatggacgttacccatttttatcccagaggcctcttacgttgacttgaaaagacggactatgtctttcagagatcttgtgggtatcacatcaatcttgacaaattttctaccctccaagtcatgatcctaagaacagcttgcctcccatttctccggtttgtgctattatgaaggccttattgtttcagccttcttcaatcttgagggttgttgtcactgtatgggtggttcagaaataagtaggtcctgttactatgaagggggtcacagcttttgttggcatagctaaacttt

SEQ ID NO: 2076 - DNA, 392 bp, Homo sapiens
  ref <308>: DATABASE ACCESSION NUMBER: Contig20629
  ref <309>: DATABASE ENTRY DATE: 2001-06-18
ttctgactttttattcttaattgcaaatgcacaaaaaatattctaaacataacaatggccaattttcaatcatatgagtttggcagtggttaacttttcacttgataatttttcttatgaccatctgcaatcccaggggtgcattttagcttgaaaatagcaagaacaaaaccccaagaaatcatggtttcttagtccatttgtctagcacacaactctctttatatattatgttttctgctagtactcaagaaatccttcaccattaaagcagctgccagtggggaatcgtgtacctaaagtctttcatgttaagtagttttgggcttatagttccagtatctagaagaaaagtgtgaacagaatagaagggataaaagagaaaggaaagt

SEQ ID NO: 2077 - DNA, 402 bp, Homo sapiens
  ref <308>: DATABASE ACCESSION NUMBER: Contig20651
  ref <309>: DATABASE ENTRY DATE: 2001-06-18
aggagaaaaccacttttaattgaaaaataaagcaatacatctcaaataagactctgttttaacaataaaactgtaatttgttgaaatagctttcctaagtggtattgtgaaatttaggtattggagtatcaatacaattccctcctttaattctgactcagctataagtaatattaaaaataaaaacttttccccataaatttaatttccataaatctgtaaagtctatccctattcccaatgcactgacaaaaagaggggaaagtttaaacaatcattttcatactgagaaattctcagataaaagcaaataaagtattttccttatgaaaaagctgatatgtgagacacacaagactatcaatgatatttaactcattcacaaaactttaaaacacaatt

SEQ ID NO: 2078 - DNA, 465 bp, Homo sapiens
  ref <308>: DATABASE ACCESSION NUMBER: Contig21130
  ref <309>: DATABASE ENTRY DATE: 2001-06-18
aagtttaaatgttaaaagtcatatcaagaaagcaaatacagaattgcagttaatatttacaaagtcattatgcagacacactattacatgtagacagttgtagttaaaacaccttgggtatttcatttctaaagcgaagctccacaggcacattctgtttaaggttcttttcattctctcaaaagttataagcaatggagtgtgtaagttgttttaataatagttcagttctttatgtacattgtaaaaatgtcaagcatgttgattcttcaaaaagttgcatttcacttagcagagaaaataaaaatgtcccatttctcccgagaaaaaggataacattttctaattgtgcaaacactttatgaaagtatcacttgactctatattttgacagctgctttgcatttattattggagaggctcttcatacggcatgttcctttttttttccttttctagtcaaga

SEQ ID NO: 2079 - DNA, 409 bp, Homo sapiens
  ref <308>: DATABASE ACCESSION NUMBER: Contig21185
  ref <309>: DATABASE ENTRY DATE: 2001-06-18
gcttttggggggtacctgtgacaaaaccaatgaaatccaaagcactgtcagaaatggaagatcctcgggggtcaattccttcatttcacagatgggaacaccgatgtcttcttgcaccgagtcttactcaggtcacacaggcaggagttgggagatttggggctgtaggagaaatgttataacatcatcccacctggctttatccattaacatctgctcatctctgccctcagggagtcgtggagctggttgaacaataccagacagtacgtggagagccttgcattgtgttcaccacctcgctcatttttattcaaaatgattccagaaaatcaatgtgaccatctggcctcggagaaacttcactgaggtcccaaatgtcttcagtgcccagatgaatccttataac

SEQ ID NO: 2080 - DNA, 451 bp, Homo sapiens
  ref <308>: DATABASE ACCESSION NUMBER: Contig21421
  ref <309>: DATABASE ENTRY DATE: 2001-06-18
aattttatagtctttattattgaaacattgcgtttccaaatcacagtggtttctactgacaaagtgcctacaattcatttctttattaattacaaacatttcagagtaattacacagcactttatcttgtgccagccaaacctcacaacaatgctaggaggtaagctgtcacacctacagtttgtttttccctctaaaggagaaggcagggaaagaaagtcttttgcagagttatacaaatatttggcaaaattcagaacaaatctgagagggctattgataagaagctcttttcattatagacattcattctatccatgaatgagagaaaaaagagaatggaagatttatgcattacttcaattggagaaatgagataggagagtggctaacacaaaaatccctaaatattgttttagaaagtatgaaaagtggactgggtgtggtggct

SEQ ID NO: 2081 - DNA, 416 bp, Homo sapiens
  ref <308>: DATABASE ACCESSION NUMBER: Contig21787
  ref <309>: DATABASE ENTRY DATE: 2001-06-18
tttctataggagaagttcctaaaggaactgaatcaaagggtatcgtgggtttttatttttaaagacactgccaatgtattttcccccaaggcagcaatcatgaacactcccaccagtgtcctctgggactgcttgcttgcctgcagccaggccagcgctgggcattatgcctcttgtgtacgtgtgacgacagtaagggatggaaggtgacgttgactgatagggtttctcagcggaaatgcagctccacacagttccaaaaaacactgccaattccagagcattctgggcccaaatgaggctagaggggtgtgggggagcaggctgtccactcagggggccctgagcaagatggggacaccttcctcccaagcccctccccatccttgcaagccgactcctgagcctgcaccatc

SEQ ID NO: 2082 - DNA, 494 bp, Homo sapiens
  ref <308>: DATABASE ACCESSION NUMBER: Contig21812
  ref <309>: DATABASE ENTRY DATE: 2001-06-18
ccgtttctttggtggtggctcagcctttacttttggctgtttaactttgggtttcacggaaggggcttttgtagttgtagtttttgatgctagaggatcagaagttttactgctactacttggcttagcttgaacagttctgatagtttgtgaaggtttatttcttggctttttagaacacactctgacatattccttcttgtttgcattttcaatgaacttcacatatattcttttgtatttactctttgcatctccaaaatatccaagataactatttgtagcagcaaattctctttgaccatctcgaatttcaggaacaaatttctgtaataaagctttttgtactttccaaatagctggaggttcttttcctgtttttaaagcctccttaaaagtctctatgtcttctatctttaccacaaattcatcacgctctctgtattggccttctcctccgctttctgtgtcctcctcatctgtaaaaccttcta

SEQ ID NO: 2083 - DNA, 415 bp, Homo sapiens
  ref <308>: DATABASE ACCESSION NUMBER: Contig22418
  ref <309>: DATABASE ENTRY DATE: 2001-06-18
cacccaacatgcatcggatttacttgagttccaaatgtgtttgaggaaaggagagaataaccatccgggacagctgttgccctttctccacacaggagctgggggagccaggtctgcggcccccttagccatctgtcggtcttggaggcagggctgcctgagaaggggcttttggggtttccacatctccccatcttgtccactgacctcctccagcacctgccccagtcgctccttgcgggaacctcctggggccccaggacggagaccactcccaggctctccacaccctggagccagccctaggcccaccttcctccccgctggggccatgccctccatgcaccctggcccagggtggggccagcccccaacacagacactgcacccaggaacacatgagcatctggtccac

SEQ ID NO: 2084 - DNA, 418 bp, Homo sapiens
  ref <308>: DATABASE ACCESSION NUMBER: Contig23085
  ref <309>: DATABASE ENTRY DATE: 2001-06-18
acagctatgacatttcatttatttctctatataatgcaataaagtagatggattaaccgtgacgtttacagatggagcaggggagaatgaagaggcgtcagtttgggcatcaggctggatcttcacactctgacctcactctgctctatcctgcccagtgttgcttcacctgatatcaggggtgcaaggcaaccagatctgacaccagtttcagtttagatcctgcctttacctgggtgtgacccgggtctatctcttcagctcggcctctgctttctcttcataaacttttggggttagtcctcggatgatctctaaaacatggcccaggtgctccttgccagtagagtgtagccggatttggagggactggacactcagtgtgaacaagacgaaggcctcaggaggcagtaaaagc

SEQ ID NO: 2085 - DNA, 507 bp, Homo sapiens
  ref <308>: DATABASE ACCESSION NUMBER: Contig23454
  ref <309>: DATABASE ENTRY DATE: 2001-06-18
ggttagtatgagattttatttcttgattatgagcgttaataaaggcaagtgttggctgagcctggatgaaatatgagatgtttataacacacacacaattgtgacaattcaaatgcagaactttttgtttaaacaaatgattacggttgaagtagaagtataagcagggccataattcatgacacatccaattctttttcctgctgcagtcattagttcttcaccttcgcagtaacaaccatatgagtgcaacgaaatagaccatgactaaaggatttggtaagatcttgctctctaaatgatctcctgaaaatcccagtccaccatttgactccgtggcttacaaatctccagtgcttctccattacctcaaactgcaggcttaattttaatgtgttcattttttacaaggtgtgtcaacgttttatcaatttctgaaaagtgtctatggccccgaaaagttgaaatccacgacattatatcatctctgcgagccctttccagctc

SEQ ID NO: 2086 - DNA, 523 bp, Homo sapiens
  ref <308>: DATABASE ACCESSION NUMBER: Contig24138
  ref <309>: DATABASE ENTRY DATE: 2001-06-18
gggtgtttgcagcactttaattatcaagagaatataaaaatacattcaaataaatgaagaaaaatgggcaaacaaatggacacatatgaggatttctaaggttcaattaacatgtgagaacttctcaacctctcagtcatcagggaagccataagccattggatccacaaacattaaaaagtctcacaatcctaagtgtcagggagaatgctgactatcagaagtgctgagtaaagctctttacaaagctctcaagtagcatccactaatgccaaacatccccatgagcagcgactccaatcccagctgcgaaatgctcaggctcaactcaaatgagggcaggtgcattcatagcagagctagtcgtgatggccacacagtgaagacagcaaatgcccaccagcggcagggtggttaaatggtggtggtgcattcaccagcagtgtagaccaaccagccactccaggtccactggtatccgcaggactttgcagacacaggccccctataaatccattaatca

SEQ ID NO: 2087 - DNA, 433 bp, Homo sapiens
  ref <308>: DATABASE ACCESSION NUMBER: Contig24252
  ref <309>: DATABASE ENTRY DATE: 2001-06-18
cacgtaacacaaaagcttttacttggaaactggcaaatactggactagaatactgacatgctcacgctctggcgggagctcggatgcagaagctattgcacaaagcccctctgattgccttgctcctctttggcatgtatcagcagagccccaagggccaattgcccacaggtggggactgttctccatcaaggtatggggacccctacttccttgttttgttaaaaagtgcaggtaggcgaagaagcccaggcagttgacccagtctttgaaacagctgactccccagcacccagtgtccactggcagatgagaggtttgcacctataccagcccttgtttccttggtagggctcaagttgtcagtgtccaggtacctgggctgggccagagctggggccaggggagcctggtcttgaggggtaagggctgc

SEQ ID NO: 2088 - DNA, 453 bp, Homo sapiens
  ref <308>: DATABASE ACCESSION NUMBER: Contig24541
  ref <309>: DATABASE ENTRY DATE: 2001-06-18
aattaaaactgaaggaccaaagaaacccaaggaattagattcatgatgctacttgttctgcttctatcaccatcaaacattaggtaaaataattcttctttgccttcaccttgtccattttctggaggaagggacataggtttgatacaacgaatcaaaaaaacaaaaaagatcctcggggtatttatgcagtataataaagagcaaagcaatgtaattccaaaaagatagctctcaaatatttgaaaaaaaatcactaaatcctaaaacttctcttggaaacaatttccatgtctcaagaccattacattggttacccttgtaagaattttcttaggaatagtttaaaatggttactttgataatacaaaagatctcacactatagaactgctgaatggactcacaaatcacttatacttttaaagtctaaccatcccaatgtacactcaga

SEQ ID NO: 2089 - DNA, 552 bp, Homo sapiens
  ref <308>: DATABASE ACCESSION NUMBER: Contig24655
  ref <309>: DATABASE ENTRY DATE: 2001-06-18
aagcagctttattaatggattggagagcacagctgggatctgaggcctaagcaaggttcctttcttcttctgtgaagtgacggctgccgagcccactgggtggggcccaacagaacttacccacccagtcacagacggaggctggaacatggagagccaagtcttggctgagctcaccacgggcaggttctgctgggtctgtttactgcatggagactgactccaaaaggaggaggagcaggggaaatacaaagagcagcagtcccaggcccaacacaaggagcctggaaaaactcttgaccagtgggttcacccgaatatggccagtcagaatgtcgtagctccacgacaaagcacggcgagcctccttcagctcctcttcttcagcaatcaaaaaggcgttttcatctgcttccagatcctcaaatgaatctgtgtcttctctttccaactcaagcctagaaggacagtcaaagagcatgtcaatctcatcgtcatccacaggggtggggagcaggctggcacttgggttgtacactagttcagagatgg

SEQ ID NO: 2090 - DNA, 404 bp, Homo sapiens
  ref <308>: DATABASE ACCESSION NUMBER: Contig25055
  ref <309>: DATABASE ENTRY DATE: 2001-06-18
caattcagaaagtgtttattggccggagttgtcggagagccaaaagaagcagtccaggagggcttccttcaggaggcagccagcacagttgcacagggcagcttccactgccatctgccagcactgagtcctcctcatccagacacaggactgtccatgggcctctcaggggtctttggggccaggatgggacccctcagacctggcccaggtgggttttcaaagcctgcagctctcggctgttgatgttgttgcctccacacacgattaccacaactgaagtcagggaagggggcaggcagccctcggcctggagcctccgcaggaggcctgagtagatggctgctaaggctgccccacaggcaggctccaccagcatacgctcatcatccaggagctgctgc

SEQ ID NO: 2091 - DNA, 432 bp, Homo sapiens
  ref <308>: DATABASE ACCESSION NUMBER: Contig25290
  ref <309>: DATABASE ENTRY DATE: 2001-06-18
gcattccagagtttttatttttcttttccaaagaaatatcaccattaaatttccaaaatacttcctattatataatagactcataagattgttatgaaaaaatcatttcaaaaacattaaatgttttcgggggttaaaacatggtaatttttaacaaacaaagtaaaatctagagcaaactgaagcattcactcaaagcaacaacaataaaacaaacaaattcaccaaagcaattgcatgtttttatcagacatggtgatttcaaaggcctcaaggtaggcaattagtaatgccatcatctggtaaaaagagcaccagaaggggaatctagaaccctaggattttgtcctggttgtcactgtataactgacactgtataacataataactgtcactgtataacataataagtcacagttaccagttacttca

SEQ ID NO: 2092 - DNA, 399 bp, Homo sapiens
  ref <308>: DATABASE ACCESSION NUMBER: Contig25343
  ref <309>: DATABASE ENTRY DATE: 2001-06-18
aggatttagaaatattttttcttttataaaataacttggtatttttctgataatcttccaatagataaataaaaacttttcttatgctacagtacaagttgatttttaaggaaatttgtgcaaacattaagaaacaccgcattggttctgggtgaaagtgccagtctggaactctcttgaaagaccatacagtctactgctaaaccctgggactcctcagacttgcactcagattatcgtttgcctgccctgattttagactctgctaattcaagtccctgttatcttgcttgacatcgacaaggatcaccgcaccgttccttcagtttccacagttccgtcagttcccacggagaatactgaggagaagacagcattcctgtctcacaggtcttctca

SEQ ID NO: 2093 - DNA, 341 bp, Homo sapiens
  ref <308>: DATABASE ACCESSION NUMBER: Contig25362
  ref <309>: DATABASE ENTRY DATE: 2001-06-18
aaatatatgtaccaaactttaattttcatttcacactcaaaactcctgtagaaaaaaaggcaaagcaggcaaaaaaaattacaatgacttcagcaaacaacatatgaaaactgcaaaacagccttgggtctgtaatggcctttatagacgtagtgagaaaactgggttccaaggttttgaactctttaagacaaaattccaatgtttattactaacatttaaaaaatatttgtagctgcataggatacaagattgaatgagaagtctctgaattctactgcacaattggatcctaagattgggaggcttaatttttctttggggaaaacatgaaattattt

SEQ ID NO: 2094 - DNA, 371 bp, Homo sapiens
  ref <308>: DATABASE ACCESSION NUMBER: Contig25617
  ref <309>: DATABASE ENTRY DATE: 2001-06-18
gctgacacagccaggctgagacatcaacacctacaaaaactgtgggaaaacacattaaaagtgattagaaaaacaataaaagacatccgtgggtttgtgcaactctctcagacagttttatgaggaggatcaaagatgtgggcctcgactctgtgataaaccgaggtcggctgccatgatgaggacatggtttcacatgagtgccttgtttttaatgcccgtggagagagagcaggcgcacagcatctgactgagtgaagggccacctctctgaaatcacccctgactttgatcaggaggcagagccaggggtggaacaaatatatttgatctgaagagttaaattctccctcagccagctttttaggaat

SEQ ID NO: 2095 - DNA, 371 bp, Homo sapiens
  ref <308>: DATABASE ACCESSION NUMBER: Contig25659
  ref <309>: DATABASE ENTRY DATE: 2001-06-18
caaaaataatcaggcacactttttattttacatcttaatcaacattacaaatacaaaaggaaaaaagtcagaaacaactcatcacagaggaaaaaaacatcattcagaagagattaatctgaacttcaacattctttgtgctcattttaaaattattaaaacaggaattcaaaaggacaagcaaataaaaaccaagtattttattaattaaaattgagaccctaaaccaactaagactatacaacttaaaaataagctgtcttcatcctagaaaagtttgatttgccatcttataatgaatatgcaggaacttactaatgggtaagtaaacaaattttcttttacaaacaagttattttgagttataggga

SEQ ID NO: 2096 - DNA, 426 bp, Homo sapiens
  ref <308>: DATABASE ACCESSION NUMBER: Contig25722
  ref <309>: DATABASE ENTRY DATE: 2001-06-18
cctatctctttcacaagccataggggaacataatcctctttggcataaaataatgcacctttgcaaatgttctggatttctgaaatagctaatacacctaaatctatagcacgtaagcaatttaagtctcagcttgaatacgctcttagactattataaattaaaactgcaattgtaaaaggaaaattagagaaactaagtatttagagtattgtttatatactagcacacattattacagcttttgctcttttactgttctcgttctaattctgacattcttaatacctacattcctcgttgtcatgtattcccattttacttagcaacagatttattacgatacagacttctacatttacatacggtatatttaaatctaattatttaaaccttaaaatcatcagtatgcaactaaaatagtga

SEQ ID NO: 2097 - DNA, 504 bp, Homo sapiens
  ref <308>: DATABASE ACCESSION NUMBER: Contig25809
  ref <309>: DATABASE ENTRY DATE: 2001-06-18
cattttcgatatgtggtaaattttgtctccaagaaaaggtttggagactgaatttttctcttttcctaaaggaaattcatagatagaatgctgaatatcatccacatttaaagatttgacaacataaaagttagataactcttaatgatgtgaatctttaacttatgattttgagtaaaggattatctagaatcaaatatacacttattaatcttcatttcccaaaattggtccatatttagacaactacctggcacaatttcactagataaacctaaaatctgaacaatggaagttaaacttctacccaaagtaaaaacaaagccataagattccacaattgaattggccacaaacattcacactatgttataaaggactttctcatttcaaatacatcactgaatgttcaacagaatttgcaaacataagatccagaatgactagcaaaacatgctaagagcatgtcaaaaagtaaaacaccacctctccccccccaatctg

SEQ ID NO: 2098 - DNA, 430 bp, Homo sapiens
  ref <308>: DATABASE ACCESSION NUMBER: Contig25991
  ref <309>: DATABASE ENTRY DATE: 2001-06-18
agaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattgga

SEQ ID NO: 2099 - DNA, 421 bp, Homo sapiens
  ref <308>: DATABASE ACCESSION NUMBER: Contig26022
  ref <309>: DATABASE ENTRY DATE: 2001-06-18
gcttttgtcacatttattcaaactagcacctccacagtcaaagtgttgtcatcctacagcctcaaggcccctcactctcaatgtatggaatgtcatggtacttgatgttattgcatgcccattgctgcaaggcatcacacaagatatcctgagacaggcggtgtgcatattccaagatcacagtattggtccctggaggttccttcacttcctctttgacattaactggagaagccatcctaggtagacatctctcttctggcataaagggttcttcactctcatgctgcttctcaccttcatatatggtaggaaatgggaaagtttgctttgatttcatgcagcccatgttatgaagagctgtttgtggaggaagcagtggcaaagactacttccaggccatctttagaaaacaatgaaa

SEQ ID NO: 2100 - DNA, 415 bp, Homo sapiens
  ref <308>: DATABASE ACCESSION NUMBER: Contig26077
  ref <309>: DATABASE ENTRY DATE: 2001-06-18
ataaatccaatttcttttattttctgatacaataaaccaaaacatcaaattctaacatcactctcttaagtatctcctcctcagaattgtccatgaaccccaaagatttaccaggtccaagggtgaaagtgggacttgagttctcagtgcaaaagaaaaccctcaatgcaccactgcaattgcttcttgtcacatggtggcgctgttgaagcttagtcctgcacagccctggcaataaaggaactgcctaggccaccaaggatcttcaggggtcttcaagccctttccgaagtaatgcttgccaccaaaagcattctatattagagcttcaaagttgcagctcttaaagatatgctctttcatctcacatagaggggaaccttccagaacaccaactagcctaggagcagttcta

SEQ ID NO: 2101 - DNA, 409 bp, Homo sapiens
  ref <308>: DATABASE ACCESSION NUMBER: Contig26310
  ref <309>: DATABASE ENTRY DATE: 2001-06-18
tgaattcctaaaacatagaaagctgttaaatacttttgggcaatgacatacacttttgatgcctcaaactctgaaactgtaaacaaaccagattccaccccacttccaacaaaccatgtcccagttgatttccctctttctatctgatgtgctccttcaagattcaagcctcttgctgggggaggggaggagagtggtgacagcggggggggggtggtgggggcgaaggggagagattggtcaatgggtctgaagctacagatggaaaggaggagtaaactctggtgttctattgcacagtagggtgattgtggttaacaatattgcattatgtatttcaaaatactagaagattttgaatgttctcatcacaaagaaattatgtttttgaagtgatacataagctaat

SEQ ID NO: 2102 - DNA, 412 bp, Homo sapiens
  ref <308>: DATABASE ACCESSION NUMBER: Contig26371
  ref <309>: DATABASE ENTRY DATE: 2001-06-18
cagagttcagaggcttgcatttatttaacttaggaaaggaatcgagcaaaacagacacgaacacgattctgtctgaaaccatcactaaccggctatagattctgactcactcaaggaatattgtggatattttaagaaaattttcctggttttctgctttaccaaagtgtaagatatggctggggtgcccctctcagcagatgcagaataaattaatcccaaagcaaagcggagcgcagggcagcctcgcgccacctaacctgtgtctcagcttccagcttccaccctgaagtgcgtgtggtcgtggagccgcgttgcgctaaccaggaaagctggaggcagaacgaggttggcccacgacacgtacagacatatgaccgacataacagtaaacgcacacgtgtctcgcacg

SEQ ID NO: 2103 - DNA, 356 bp, Homo sapiens
  ref <308>: DATABASE ACCESSION NUMBER: Contig26438
  ref <309>: DATABASE ENTRY DATE: 2001-06-18
aaagtgtagcaaccctttaatggatgttcaatacaataccgttcatatcacttatacaaactttctcagtacaattttgttcacgatcatgataatgctgaatgacagagtgaggaagtgggattaacaaaaaagtaaaagcttccagaccagccagagctaaagtcaaattaaggctctgctcttgccagccactccaaccttaaagaagttatgttattatcatggataaatttttacacaagattgtaaaaattaaacgttaaggataaaagcccacaacacgtgactgatattcctcaaatattaatttcactatttgtgacccctaaataaatgcatcttccaggtgttct

SEQ ID NO: 2104 - DNA, 396 bp, Homo sapiens
  ref <308>: DATABASE ACCESSION NUMBER: Contig26706
  ref <309>: DATABASE ENTRY DATE: 2001-06-18
cacaattttttttactaaaagaatagatttttattaagcgttgtaagtttctttccatcagcattaacagaacaacagaccaatttccatcacagaacaactcctgaggcattctcattcctttctgaaactcttccattaactcctgaagtttccccaaagaagcatccattcaaacttacattaataaactatggagcttttgtggtgaggtgggccaaaaaggcagggaatttggaatctgggagtgggaaagagaaatacatattatccatccactaaacacactgtcaaaagcacaggagaggagatagtaatacaggaaaaaaacaatgaaataattttttacttttgtcaataacatcatttatcagggagcactaaaagtcactgact

SEQ ID NO: 2105 - DNA, 350 bp, Homo sapiens
  ref <308>: DATABASE ACCESSION NUMBER: Contig27088
  ref <309>: DATABASE ENTRY DATE: 2001-06-18
cagcaccacaatgtttaattgattcccgttccagctttctcaaggcacgacaggccccctcttcctcatcttgatttggatacaagacgccagctggcaggcaggaggtgctgctgaagccctgcacggcccctgaaaactgtcacggctcaggagctccaggctgaggcctgggggacctcgcatcagtccctccacccaccctgcccatgggtttcaccacaggcagctccatgagagccccggcccctgccctggcggcttctgctttgcgggaagggccctccgtgggctctggctgtgtccctgtgctcttccggcagtgtcagggggtagtggcctcggcctgg

SEQ ID NO: 2106 - DNA, 399 bp, Homo sapiens
  ref <308>: DATABASE ACCESSION NUMBER: Contig27186
  ref <309>: DATABASE ENTRY DATE: 2001-06-18
agcttttagttgtgagtgttctttattttcttaatttagatttaatttcttaagtatagaatgcttttcttggaaactgttcttgaagaggatgatttcctaagtatagaatgcttttcttggaaaccgttcatgaaggggatgatttgcaacttctgggactccaccagtttgataaagcaagtcctttcacatttgccatctgggctttggtttccctatcttcaaagtcacaggtatactatttattctgacactctatggtggcgataagttaatgttgggatgtttatcaagttggagaaaagctgacatctaagcaaggttttctgatacacctctttcactgattcttttgcaggtgacacctattgaaatatttgtttacccttatcaaag

SEQ ID NO: 2107 - DNA, 439 bp, Homo sapiens
  ref <308>: DATABASE ACCESSION NUMBER: Contig27228
  ref <309>: DATABASE ENTRY DATE: 2001-06-18
aaaaacgtttaacttttatttgatgcttctgaacataataaaataaatgaacctaaaacagcgctttaggcagcttggaagggaagatacattccatttaggttaaaatacatgggaacgatatgtacatttgggcagatattctgaactctactgggttaatggttatgcctgtacttgagcacatcagtgagaagtttcccatcacattttatctgaaatgaacaagatgtcagggcaatctgctagcaaaacctgcgctcggggtcagcgatgcttctccctctggaacactcatcatgcccgtccctaggacacgttgcctctcttcttttgcaaagctttcatgaggtctgacatgaaatcttgctccccgcctcctgctccgccggggtgccctgggttctcttgcctcttggggggcacaggaggcctcttg

SEQ ID NO: 2108 - DNA, 442 bp, Homo sapiens
  ref <308>: DATABASE ACCESSION NUMBER: Contig27312
  ref <309>: DATABASE ENTRY DATE: 2001-06-18
catgaataattttatttttattttggtcatgactttttaaaattaatggaaagtctcagtctgctcaaatgataaaccaaaaaatggggtcatgaagcaaattcagtctttgcatttcttcaacaaccaactcacatttctctgctccttgactcagaggctggacatgtgctaacagcttttttgcttctgtatatccttaataggatggcagaatcccggtgttaaaagaatcttaaagtcagccgtgtcaccatgggacctcgattagcaaacagatgtagacattccttccaaattcagtcaaagaaaaaactctaataccagcagccatgttcagggtgtgcacgacatgctgagcgcttgggatacatccccttgtttaattctcacagaaactttgtgagacaagtactataatccctgtttaacagatgggcaa

SEQ ID NO: 2109 - DNA, 417 bp, Homo sapiens
  ref <308>: DATABASE ACCESSION NUMBER: Contig27344
  ref <309>: DATABASE ENTRY DATE: 2001-06-18
aataaggcattgattttaattactggccatccatccagccccagagcaacctccactctgtttggttttgatgaacaaaatagaagcaacaatcaagacatcaggaaattacatgaaaaaacatttaaatcttaaaatctttcacaggacaacagtattgatattggactcaaaactgacaagaaggaagaaaacttccgtgtgctcatatttttgagatgaccacgttgagaacagatgactgactccgagttccattttctttaagatattttgagcctggccgctctccatgcgtggcttccttctctccagctggtgtccctggaggctgcagccagagccacaggcccatcctggctactgcactggtgttcggtggccgcttttttttttcctctctgcagaacacaaatc

SEQ ID NO: 2110 - DNA, 438 bp, Homo sapiens
  ref <308>: DATABASE ACCESSION NUMBER: Contig27386
  ref <309>: DATABASE ENTRY DATE: 2001-06-18
gtcatattaagaaaagataaaacaaactttactcatttctgcttctgggcatggagtgtgagggaccagacttaagttctcaaacaactacaaaatcagaccaaaaaatacaatggtttccaggcaccggacgacaggcagtgcagggctgtgatccttaagagaagggaagcagcgagccagagtatccaggccacaacccaaatggaggccaagagaggaacagcagaggatacagagggagggttccaggggccaagacgcaatccgaggggaagcccttccggggagagctggagtcctggggtggccttctcgagtcttcccgagcaggtctgtgcagcgaggaaacatccgaggctggagtgagccacgcggaggaggaagaacagcccgagctcacaggggcggggaagagttctagctcgcgacacccct

SEQ ID NO: 2111 - DNA, 468 bp, Homo sapiens
  ref <308>: DATABASE ACCESSION NUMBER: Contig27624
  ref <309>: DATABASE ENTRY DATE: 2001-06-18
aaaggctttctgtccaaagatgaacttttatcgattctttcaattattgccacaattgaaaaggtgtatgtccaatcatttttcatggttctgtttttgcttactgtcataggatttcatcccatctcatttgagttgcaatttcaaaaagcaaagccttgctcttttctgactgaattcaacatgcataaagaattttatggcttggatcctatggctcaaaaaggtttgaaaacatagcaagcagcatctatttaaaaaaatcctagggttgcaaaatattacaaattgactttgcacactcagactgaagacattataaaagacaaacaaaaaaggtgatacaactcaactgcaactgcatgatcatctattataccagtatgcactgaaatatatttttataaagctctgcagatattaaaccctttcaccagctaaagtcatggaaatgctctctttaaggca

SEQ ID NO: 2112 - DNA, 433 bp, Homo sapiens
  ref <308>: DATABASE ACCESSION NUMBER: Contig27749
  ref <309>: DATABASE ENTRY DATE: 2001-06-18
aggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaa

SEQ ID NO: 2113 - DNA, 428 bp, Homo sapiens
  ref <308>: DATABASE ACCESSION NUMBER: Contig27882
  ref <309>: DATABASE ENTRY DATE: 2001-06-18
ctactcaaagtgtctttaatgattcccaccactggcattacatcctgtacgcttttaggtggatttccggtgaggtgatgcacctctgaaacccttgctaagtagagtatgttccagttcaaccagcttgttttccaccatactgaggtttaccaatattcgcttctgcctggctattgagtgtgggaaattatttaaaatatcccgagagaggtcgtagactgcaagattgttgtctgtattgctgttaattaacccagaagaagagggtctcactagtgcaagagcagttgaatttgatgacatttcgccagtgtttctctgaaagcggcgatatttccagaagacaatcaaggcacacagaatgctgctcgctaggagtaaatagaagttcatgtttcctcttcggcctcttctcccttctcggg

SEQ ID NO: 2114 - DNA, 421 bp, Homo sapiens
  ref <308>: DATABASE ACCESSION NUMBER: Contig27915
  ref <309>: DATABASE ENTRY DATE: 2001-06-18
gtgagtgtatcattttatttccttattctatttcaacaatagagtatatggctccatatgaatagcttcagctgtcatccatttccccaacaattatgccctttgtctccaggtctcattctctctccacttctgggccttcaagtcctgaggatcagtttctgatgtgggacagggatacagccacccctcccaggcagagcatgtcctgcaggggtggctggcctgaggaggtgctagggggaaggccctccaaggaggcctgcagggtctgggccatgctgtggtcagccaggtgtcccatgctctggagctgctggaagaagccatgcagggcctggagtgtggtgttcgagagggtagacaggtcagccaaagccacaccttgcagaacatcacccacctcttcatgagagaggac

SEQ ID NO: 2115 - DNA, 393 bp, Homo sapiens
  ref <308>: DATABASE ACCESSION NUMBER: Contig28030
  ref <309>: DATABASE ENTRY DATE: 2001-06-18
cggtgaattaaaatgtatttggtgccagtggtgctgaacatagaataaaaaacagaaaaagggcccagacagggacatccaggctggaggttggagtggagcacagtcagatgtattcacttttctagcatgggtttcaaagtgcgtaaggggagaaaacgcatcatggattgtgctgtgcatcctggacaccgtgcgaggtgctcatagctgtgatcttgtctcccacaactctcttgggtgacagacgtccactgtccacattttatagacaaggagaaagggaagtcaaatgtctcgtccaagtctacacagctaaaaaggggcagaactagggtgacgctcaggcctcatttagagatcgggggttggcgagaagtggggtgggcttct

SEQ ID NO: 2116 - DNA, 397 bp, Homo sapiens
  ref <308>: DATABASE ACCESSION NUMBER: Contig28081
  ref <309>: DATABASE ENTRY DATE: 2001-06-18
gaaaaattcacatatttactgtgcattattaacaataacttacttattgaaaaaaatttaaggtaaactattcaacttttatttacatctgtaaaaacttgatctaggtttcttaaataagaaagtggcttgaattttaaagaggaatcaggtaaatctattttctcttcctctctcacgtttttcacactctgccttcaccatcacacccctgttgactgtgaatattacacaaaagtacttattcctgttttttacaatgttcaattaaagaaattggttgacaattctggcctttggaaaaagacaaggaacgtaggtaaacaaaggcgtaattaaagagatatcttaattttagccaatcattgatgaaccactctccttgctcatgaggcgg

SEQ ID NO: 2117 - DNA, 415 bp, Homo sapiens
  ref <308>: DATABASE ACCESSION NUMBER: Contig28152
  ref <309>: DATABASE ENTRY DATE: 2001-06-18
gggagtgatgtattcttttattgaagcaagtatgtccagtcacaccaaaactgacgtcctgcattatggtacagcttcatactcagagttcatctcaaataccaaaacatcaaatcagggtatgtatcaaattgggaaaataaagtagcagacagacactgtttcaagtaggtactagaactgatcacccgtgaagtgcacgtggatgtgtacagaaaccgttctaaggctgtattccaaatatatattctcaagttttaagcctttctcatctcaaagacataaacaaagcaatatgtactatcaatatacaatctgtactagctagaacctcagaaagtgcaaacacactgtgacaatacagtggaactattcctgctccacccaggaccagaggcatgggcagcgggcccag

SEQ ID NO: 2118 - DNA, 410 bp, Homo sapiens
  ref <308>: DATABASE ACCESSION NUMBER: Contig28179
  ref <309>: DATABASE ENTRY DATE: 2001-06-18
cattgaaatcattgaaaattcaccctgttcccatctgtgtgacaatgagcatgcttttaggtccatagatgatgcaaataatgaataaaacctaatgcaaaaaaaaagggggggatagagtgaacatctaacacctgtccgggttgaataattctgtctacccaccctcaaacattcattttaccgtgcttttttccatgaggtcatgtatacaaatgattcaatcatttatttacttaacgaggcactgaatggatgactatacgtagttctcaggcaaatgtgatgagaaccgtatcttctgtttcttaaccactctcttccttgggtttcttttctacgaaatggggaagaggtcactgtgacttcagttttacgagaaactgagtgcagagataagaaaggttcaa

SEQ ID NO: 2119 - DNA, 370 bp, Homo sapiens
  ref <308>: DATABASE ACCESSION NUMBER: Contig28550
  ref <309>: DATABASE ENTRY DATE: 2001-06-18
ccgaaaatactttaatgcgaggtcctcgtgtgggtcgtgttttggagagataactggccttggactggagggtggctgccttcttcctttgccaggtcatgcgaggggctgctggccaccccatgcacatgcccctgcccctccatgtcagatgcgtgcccctcggggctggccgtgtccgatgcaggccccttccggctgttgatcttgatggcggcgcgcagcgccgacttgaccgccgtctccacccagccgtgcgggtaggcggtgtgctcgccggcaaagtagatgcggccataagggaccgtccagtcatccttttcggtttgccagagcgccggcggctgtaccacaaagccaccctggctgt

SEQ ID NO: 2120 - DNA, 391 bp, Homo sapiens
  ref <308>: DATABASE ACCESSION NUMBER: Contig28552
  ref <309>: DATABASE ENTRY DATE: 2001-06-18
gcaatttataaatacggtttattaccatggttacaaactttcagaacaggcctctgagacattggactgagactctgccgaacatcttttggcatcggtgtcctttttcttctgtcgcggaaggcagccccggactgcaaggcctccagcagattatccatcactcctgtctcatcaccctcagtcttcatttctaataaacgctttttcttttgttggcgttcgagtctttctcgctctgctaattctttagctattctgacacgtttttctttttcctctgcttctctttttttgatattctcctttattgcttgcatgaatgtggttctgaagttattcaggtcagtaagaaagtcttccacagacaccttcttcacatcaatggcat

SEQ ID NO: 2121 - DNA, 422 bp, Homo sapiens
  ref <308>: DATABASE ACCESSION NUMBER: Contig28712
  ref <309>: DATABASE ENTRY DATE: 2001-06-18
ggaaagatgaaaaatttattagaaaagatctttaaatggcttttactaaagcgtcatttaacaatttttcatattatagaaacagcttttcatggatggtgtgactgggtctgtatccaaacccggttcggttcctggagccaacgctaatgttaacactcagcctcttgcagttaacactcagcctcttaactgggagtggccctggagcaagtcgctggaatgttcaagctccgcgtcactcatcggtaccaagttgatgatctctgcctagggttcttcgccaccctcaggctcaagtcccaggaggcctcctccgctgacttgggtgaacagctctgagttccggagagggttcggtctgcggagaagcgcgcgagagacaagcatcctcaaggttctggtacaaaatttggaaaatg

SEQ ID NO: 2122 - DNA, 372 bp, Homo sapiens
  ref <308>: DATABASE ACCESSION NUMBER: Contig28888
  ref <309>: DATABASE ENTRY DATE: 2001-06-18
atggatatctttctgttgtaatgctttttttttttgaaatgtccatttctaagacttttccagatacttcatccaccatggactgttttccataaattttcttatgaccttcctttagtttccattcaaattcacctatgtcagaccgaaaacggccatccttgcataaggctccttcaatagtctcacccttcaaggcataaatacaaagtttacttcctttttcatgaagttcgttgatcttaacaatcttctttcttgtccttcctatagcaacaacatgaaaaagaatgcattccatgtttggattttcacattggcgtaatatgtgtccatcttctttgctactctttctttgaccaaatgtaattt

SEQ ID NO: 2123 - DNA, 450 bp, Homo sapiens
  ref <308>: DATABASE ACCESSION NUMBER: Contig28947
  ref <309>: DATABASE ENTRY DATE: 2001-06-18
gggttcaagatcttttattttcagagcttccatcagttggttagtaatgctagctaagctggtataatctgaaggccatcccacctttctctttaggcagtcaaccaacagaatctctttcttacaaacaatatcattaaccagttggaatctgtctcaatgcgcgtgtaggaagaagtcctctcccccacatttttcccaacaagattgttttatagccaaatgtaactcaaacccgtaacacagcaactagccatctccagtatcactgattcccaccccaagaagttgaggtaagaggggagagactgtctcctgtttaagaaaaacccacctacacctcagtgaagccgtgatggtaaggaggctggcaccagagggcagggatgagtaggcactgaaacaggtctctctagaatcaatgaagtctgccccagctccttggatgag

SEQ ID NO: 2124 - DNA, 427 bp, Homo sapiens
  ref <308>: DATABASE ACCESSION NUMBER: Contig29126
  ref <309>: DATABASE ENTRY DATE: 2001-06-18
ctgtgtttagcatgtcttataaaagaataagatggcatttgttcagttaattttgtttttgaaatggtgttttagatgggtgaatatgaaaataagcttacctcatcccactctaaaaggtagttggtgatttttgaaccgttgtcaattggtgcctaaaaaaaatagtaacatgagattagagaaagttgttcacagacaaaacttatgagttacccacctggctcacatacagtgtctatgatagtcctgtgctctcccctcagggggataaagctgatggttcctgcgttccttggtcaatcatcatcatacactaactttgacatacctcaacagtagagagagtccccactatgaataaatcatactccacaaatagccaaacctacctaccaccaccaccacctctccctttttacaccct

SEQ ID NO: 2125 - DNA, 377 bp, Homo sapiens
  ref <308>: DATABASE ACCESSION NUMBER: Contig29193
  ref <309>: DATABASE ENTRY DATE: 2001-06-18
aaggcaacacgttttacccacagaacaccatttggaaaagaacacataaccccattttcaccacaaccctaggtggtacatacacaggagagtgacacattttacaaatgaagaaattaataattaaaccaattcccttacagagcattgtcttgccattaacaaaccactaaaacttacattttactatctttataccaattttttagcatctttattgagatatacttcacgtcataaaattcacccatttaagtacagcatatgtctaatctataaagatgctacccaaagtttagttctcaatcttacaaaatcttacaagatcatctgaaagcagatcagaaatgcaaattctcaggctgtacccaagacct

SEQ ID NO: 2126 - DNA, 372 bp, Homo sapiens
  ref <308>: DATABASE ACCESSION NUMBER: Contig29369
  ref <309>: DATABASE ENTRY DATE: 2001-06-18
gaaaaaagccttatagtatcacctaccacttaaaaactttgtttcctgctgtctataggatgaggtcaacattcatagcacagcacttaagctccaccatgcctctcatttcatctctcccaacatatacagagtcccatgctctagctccagttgatcctttccaacattgccatgctcttttacgtttgcacatgaagttccctttgtctagaatctctgattcctgaacaaatttacctggcaaattccttctcatcttttgtgaccaagctcaaatgacagctcctcagtaaagctttcctcaatccttttagcagagatagtagatacacaagtactaggcaacttctattacaatgctaattactt

SEQ ID NO: 2127 - DNA, 382 bp, Homo sapiens
  ref <308>: DATABASE ACCESSION NUMBER: Contig29639
  ref <309>: DATABASE ENTRY DATE: 2001-06-18
caaattgacacattttattaaatataatgtgcaaaatataatgaagtaacttctatttaaaaaatggtacaaggcaggtattatttaaaatgctttagtaactcattttccataaaaagaaatctggcattataaaaatacataaaataatcatgatttatatcattaatttacgtaagatacttttttgcataaaacaaagttaaaaaatagtttaaaaaggtattcttatatgagcatcattcccagtataaaaattttcataactttttgtaattttggttcatctgtataaataaagcatttttatccttttaaaattcataactccatttaaaaaacataagattctctctcttttaaataaaagttcacttgaggt

SEQ ID NO: 2128 - DNA, 347 bp, Homo sapiens
  ref <308>: DATABASE ACCESSION NUMBER: Contig29647
  ref <309>: DATABASE ENTRY DATE: 2001-06-18
gctgcaaagagcacctttattcacagcaaaaggacgtcaccatagcaacaacacttcaattccctgagaacttttcccttatcattcgctttcctagctatgtctttgcaaagagaaaaacaacaagaaacacagcccacgggacaggtgagccatgctgggcccagcggggaggtggcagctacacaggaggagggcagggatgggaggttccagatgctggaacgcataaatacacagagtgccagacagtcccacttcagctttaaaaacaaagatgaccccgagtttggcttctgttttttctgatccacagaaaagataagataaaataagaccctccccca

SEQ ID NO: 2129 - DNA, 393 bp, Homo sapiens
  ref <308>: DATABASE ACCESSION NUMBER: Contig30047
  ref <309>: DATABASE ENTRY DATE: 2001-06-18
attaaactgaacatttttattccaattattcaagtttttgctgcacagtattttcaaatgttttattttcaaaatgactattacaaaaaatgtagtttccagaatgtcatggctacacctcaacctactccactcttgcagtgggggcaacagctttaggagcagggaccgtgtgtgggggctgcacccttgcagtgcgtggcctggacacggcccaagccctccgccgcccacagacaacactttcacattgataaatatgcatgcccatcaaatcctgctgtaaaccaaaactaaaattctaagtcccccagccaactgagtgcatccccttgcagccaccgggacccaaagaaacctgaaaaaccagttcaggccatgaatgggaaggag

SEQ ID NO: 2130 - DNA, 493 bp, Homo sapiens
  ref <308>: DATABASE ACCESSION NUMBER: Contig30092
  ref <309>: DATABASE ENTRY DATE: 2001-06-18
aagctaaaatgttattgaaaacaaatgtttctcaacgagctgcttcggaacaatataacgtattatgaagctccgtacattttacatgttcttgcaatcttgacaggacaaaataagtcctcaactttttcctttgaattttgaaactgaaaccattttcttccttttccagactctcctgcatcaagaccgggctgtttggaagaaaccgtgtaaaaagtgcatgagcagtgagcatggaagacatggaaatgggatgcgtctggggctgaaggtagcattgactcagcgaaggctctcactctgcttccgtggtccccgctggggcagccagtgtcaggccaggccaaactgacacagcagaatgaagggctgtacagtgggtccccatgaaacatgttactaaaaaaaggtgcaacgagaaccaagtccctgtgcattcttagtcacaacggtgggcagaagaacccatacgattcctccctttggtatt

SEQ ID NO: 2131 - DNA, 376 bp, Homo sapiens
  ref <308>: DATABASE ACCESSION NUMBER: Contig30154
  ref <309>: DATABASE ENTRY DATE: 2001-06-18
ccattttcatatcctattttatttttgaagtcagtgtccagaaagaaaccgacgattcactcaatcaacatgtaagcgactgaggcatccctacacaccaggtttgcaggctagggaccagagacacgatggttaaacaagccagagccctgtgatcctagggcttacaatgctggcataagaaaatccttctggactcactgtccccatgcttgtgactgtcatgtgccaagtgcgctttacacaatctcatttttccctcaacttggggataggttttgtatcattcccattacagatacggatgctgaggttactgagtggaagaggaaacctgaattctgctgctggaccccaaaactcatgttaattaccc

SEQ ID NO: 2132 - DNA, 355 bp, Homo sapiens
  ref <308>: DATABASE ACCESSION NUMBER: Contig30209
  ref <309>: DATABASE ENTRY DATE: 2001-06-18
gattttccaaagaaaacaaaaaccactctttacttagaactcttgcttagacacaagagaataagatgactttaacatctgagatatacatcaaagtggccttttgacagtttctttcaatttttcggtgtcacttcctttaccaggttcaagtcagaagcagaaaaatttgaggactgatgggcccaggagttgagttatccagagtggaagatgtattcatctcccaggctgagtaaggtttacatatccaaatgaggagaaacaggtttgcttcttctcttattgtctaaaggtgtctgaggactttggcaagatgtcatggaatccttcagattttgtttgtgcagaggat

SEQ ID NO: 2133 - DNA, 373 bp, Homo sapiens
  ref <308>: DATABASE ACCESSION NUMBER: Contig30213
  ref <309>: DATABASE ENTRY DATE: 2001-06-18
gcacaaagttaatgaaataattattttttggtcataccttgcacggaaaatctgccaatagcatttgacatttagacccactaggcatcttaagtagcctgctactcacaagacctaccttttcccactgccctattttacaaacactcttagctctgtctcctgctctcctctcctccaggaagctggagaacaatccacgaacagtagtgactaagatggcccctaatgaccatatgcttgtattatggccttcccttgagtatgggcaggatccatgaatgggatggaatacattcctttgattaagttatgctgtgtggcaaaagagattttgcaggtataaagtccctaatcagttgactctgagtta

SEQ ID NO: 2134 - DNA, 382 bp, Homo sapiens
  ref <308>: DATABASE ACCESSION NUMBER: Contig30230
  ref <309>: DATABASE ENTRY DATE: 2001-06-18
atctgaaaatgtagtttatttcatctgaaattgttttctataatttccctctccacccataaatgaccttctttttatactcatggatatactcacttatgaacctgtagactatacacttcacagaaataggagaaaccataatgttctcctggcactgagggaatatcaatggtattctaaatgaggaactattaactttttattacaataatgattttttagtaatttccatagtttgaaatgtggttaggatgctactggcagttgaaagctgacaacatgattgaatagttttaacatgatctggtgtttgttacagtgctttaaaattttaaatattatcattcatgttataatgttatccagtgatagtcaatta

SEQ ID NO: 2135 - DNA, 432 bp, Homo sapiens
  ref <308>: DATABASE ACCESSION NUMBER: Contig30267
  ref <309>: DATABASE ENTRY DATE: 2001-06-18
actaaactaaatggtcaatactgccatctctcttgataatgacaaagtgtttgcacaggatgcctacaggtgtgtgtgtcgctcctcactaatggatccgtagtcatatagctgtgagaggcactcctgggttgaaaatgaaggcaattatcacattactgtcagtcctgactgagtcacctctagagtttatgctttcagccttaattgaaatgaagacaattatataaaattctcacataattgatcacaaatgtgatcacagccactcttgactaagattggtgccggccaatctgctgtgagggaatgaagagaggagaggaactgcgatgtcagtccctgattctactgcaagtttccaagcacatgaaatcccattctagctttggagaccccaatgtgacaagaatctccctgtgctttaaatca

SEQ ID NO: 2136 - DNA, 398 bp, Homo sapiens
  ref <308>: DATABASE ACCESSION NUMBER: Contig30390
  ref <309>: DATABASE ENTRY DATE: 2001-06-18
ggccttcgagatcttttatttttctaaaggtgggggttgcccttctccatccccggccagtccgacttggtgctcgcgattgaatttaaacgaataatccctacttccccatccaaaattagcggataggcgcccttgcaccggaaggcctcctcaccagtcttttctttttgtctttgaaataattcttagcctcagaagtcagcattttcaagacctggcatccgcagcgtttctgacgcggggacttctctcttcggctctgaggtctccgcgcgcagaacccatggcagcttttggtcttacgcgtggctgtgagctgggctcagctgcgtggcgcatccacccctcgattgacgcgcggagaagcatttttcattttttctttcagcttgtat

SEQ ID NO: 2137 - DNA, 437 bp, Homo sapiens
  ref <308>: DATABASE ACCESSION NUMBER: Contig30480
  ref <309>: DATABASE ENTRY DATE: 2001-06-18
ccaaggggagaatgaagccattttatttaggggaatgttaaaacaaagccatatacaatctgtaacaaatacaatacaattgtttgttccctagtcctgaataattacagtatatacaaaatctgtaaggcactggttcccccaaaagaacaaatgagtcttcttgtgaaacagacaacgaaacccctatattgccaacttttctccaaaaaatatggcattgtttttttgttttgttttacaagaggaatcacaattgctaaattaagtcacttctgatgccatttctttcatttccactgctatgtgtctgggttttctaaggcaatgtaactactgaacatgttcaagtttaaaaaactatacttctctcagtgccgttccacccacaaacaaagaagaatcagatcagaccaacaacataaaacttctaatga

SEQ ID NO: 2138 - DNA, 430 bp, Homo sapiens
  ref <308>: DATABASE ACCESSION NUMBER: Contig30609
  ref <309>: DATABASE ENTRY DATE: 2001-06-18
caaggcaataaaaaaaatcattttaatttttgatacatattaaaacatcttagtcagttcctcctgacagcattaacacagacaaatacacaagacttcaaacatgctttaaaatgacattcagcaaagtacttaaaatttaataaatagcaaatcacacacagatacatttttcataatcattaaactactaaaacagacagttaaagaataaataaaccgcaactgacagtaaaaaaaatatgttgggttttgcaattcacactacttaaaaaggggggatgatctgaatgatttcttaattttcttttgagagtgtagcatgatcccccccaggaataaaatatattgaaaaaatcactcttacaacaatgtattttttaaatacaacaaataaatatgaaaccagcaaagcaatttcaagttgtaa

SEQ ID NO: 2139 - DNA, 503 bp, Homo sapiens
  ref <308>: DATABASE ACCESSION NUMBER: Contig30934
  ref <309>: DATABASE ENTRY DATE: 2001-06-18
aaataataacaatttaatagacaaacaaaatagtatcacagtgaataaaatattaaagcattatctttttatcattcaatagcatgaagagttttctggtgtcatacaaagattgctctctaaagccaaattaactagaaaaaaagactgccacaatacacggagacacaagtttatcactgtagacattatacagagaagcaaaacacatcgtacccatgtccagagctttctagaaatctcattatataactcaccaatttactcaatgttacatttcaaacaaaacgaacatttttttaaaaaaaccttacaaatatataaatccaaaccacaaaacatcttctaaacatggtatttactctaaacacaaatggatttctggaaattgcatcacaatgctatctaaactagattttatgaaatcataaatgtatttagctgtatcttggggcttaaattcattggaccatatcccatgtatactattctcatcctactta

SEQ ID NO: 2140 - DNA, 444 bp, Homo sapiens
  ref <308>: DATABASE ACCESSION NUMBER: Contig31150
  ref <309>: DATABASE ENTRY DATE: 2001-06-18
cagtttatgccaggttcagagtagaatgtgggtaggtgggctaacaccttgctcaggggtcatttatccagatggatgcctaatatgcccttctcaatgaaggaggtgactggagagggtaggaaaaagctaaggataatggtttcctctacatttcataatttaaaatagtactatattaataaaatagttcagagagaagaaaccactcaaccatgagttttcttagttgtatcttcattattcctgtcccataaaatcctagcttaggataagttatccattaggttttgtggtagcattctatcaccatttgcaaaacctaacttcctacatacagatgtttatgtttcttgaactgagatatctgaatgcatgccatcttgactacataatcacaagtaggtcaacccaaataaagatcatctccatttaaatcttaca

SEQ ID NO: 2141 - DNA, 417 bp, Homo sapiens
  ref <308>: DATABASE ACCESSION NUMBER: Contig31186
  ref <309>: DATABASE ENTRY DATE: 2001-06-18
ccaacagacatctcattttaatagtcctcatcttataaaagtgagattacagattaacatgttaaccaaagaaattactaaggtgttttgttaggataacatcacacagaatttggtctgaacaatgcaaaaggcaaatacgatgtataaaaacatatacaaaccgagcatttgttataggtactttagaattaatttctatcctcttcccgaggataacatcacacagaatttggtctaaacaatgtaaaaggcaaatacgatgtaaaaaacatacacagagtatttgttataggtactttagaattcatttctatcccctccccaataaacttgtccaattactttgttctaaattaatccttgggaacgagatcttgatagtagcttcagttcatccaacctaggacacttagc

SEQ ID NO: 2142 - DNA, 446 bp, Homo sapiens
  ref <308>: DATABASE ACCESSION NUMBER: Contig31251
  ref <309>: DATABASE ENTRY DATE: 2001-06-18
taaattatttaatttggaagaccaagtgcagaatcttcctcttcttataaggccaccaatcctatccagttaggaacccatcctaatgacctcatttaaccttaattacctcttataagtcctgtctaggaatagagtcatattggggtttatggcttcaatatatgaatttggggggatggggagacaattcagtccatagtaaacactttctcaaagagtagttataatgtttataagagacaatgtaggtaaaagtagtttcagttgcatgcagctaaatgcagtttagtatcccttcagagtcctccgcagaaaaggcacctgataaatatttatgtggccttaacctaaggtattattctttatatagtgccttcccatgtaatgattgatgtcatgtttatcattttgcagtgcagtttatttcttatagggtcatggct

SEQ ID NO: 2143 - DNA, 417 bp, Homo sapiens
  ref <308>: DATABASE ACCESSION NUMBER: Contig31288
  ref <309>: DATABASE ENTRY DATE: 2001-06-18
aacttttattaatctttattttaaaacataaccagatgcaccttggttgtttacattctctggttgccattcagtctcaaagtaaacactgggagcatatgataaatcgtagtttaaggaagccatagcacttacagagttctcaaatggttacaatataaaatctgtcataaaaatcagtaaaagatgcaaggtagaacacattttaacactggtacaatggcagtagcagctttgcaaatgtttgtctatatgatttccacaggactttttttttttttgcctggcctcattatgtagcaaagcattttttcttttctttttgagatggagtcttgctctgttacccagcaggctggagtgcagtggtataaacacagctcactgcagcctcaacctcccgggctcaagtgattc

SEQ ID NO: 2144 - DNA, 440 bp, Homo sapiens
  ref <308>: DATABASE ACCESSION NUMBER: Contig31291
  ref <309>: DATABASE ENTRY DATE: 2001-06-18
ccacttatatgattattttcttcatcagcaaagggttaagagcagtttacaccaaaccaagttaccaagcagatcacaatcagttcacaggttggataagtcacggcacgcaggccagaaaatgtactcagacttcagtcaacctaatgggacagtgtactcacactgtggttttgttgttttggagtctagaagctccatctacccattctccatggtctaccaccatgttaacacagatttaccacaggcgccatctgtaccaagcctaggatagactctttaaaaaaaaaaaagacctggccggtcacagtggttcatgcctgtaagcattttgagaggacaaggtgggtggatcatgaggtcaggagttcaagaccagcctggccaaggtggtgaaaccctgcctctactaaaactgcaaaaattagccaggcacg

SEQ ID NO: 2145 - DNA, 428 bp, Homo sapiens
  ref <308>: DATABASE ACCESSION NUMBER: Contig31295
  ref <309>: DATABASE ENTRY DATE: 2001-06-18
gcaataaatgctttttattgtatgctcatttcaatgagtaacatttagaaataataatcccacataacagtagcgatcttattttacagcgtgtacatcatttacagccacataacacacaattttagtagatattccaaatttaatattctgaagttaagaaagataaaaaatttattctcaaggaactgattcttatctggtgcaaaaacagaaaggtgaacattatttgaaacacaaagccacaatatagcatgaagtaaaattacattttaattatgttgaacagctgaatgtaaacatgaagcaactaaaacttaaaagtacatatcatatgcattacatttatgaacaggattttcataaaatttccctaaaccagcttttaatattaagtgccattttgatttgcagcatgctaacacaaa

SEQ ID NO: 2146 - DNA, 356 bp, Homo sapiens
  ref <308>: DATABASE ACCESSION NUMBER: Contig31424
  ref <309>: DATABASE ENTRY DATE: 2001-06-18
gaagttcataaaatcttttccgagccagcgggttgcagccagagctgccaagttcaaaggcattgcgtgggttcaagtgccccccaaggctgttgctcagtcacagcttccagagcttccttcccaccacactgccaggagctgccagagcccccatgcagcccctgaccccagttccctcccaagtcccagggcctgaccctgatatctggggcaaggtgctcgggacatagataagtgaaatggtgtgcagaggcccagtggagagtcacatctcggtctcagccaacagactgtcccctagtcctgacgtcattagcaccatctgagagctgggatcgttggggcacatccag

SEQ ID NO: 2147 - DNA, 415 bp, Homo sapiens
  ref <308>: DATABASE ACCESSION NUMBER: Contig31449
  ref <309>: DATABASE ENTRY DATE: 2001-06-18
acaggatatatatttattaacagtgaaaaagcatttacccaaagtcaatgttacaaaatacaaagagtacctccacagtctggccagctcattattttaggcattatctcaacctgcataaagttctctctcactcattttgaacttttctccctctatctatctgtaaccaaaatttttaacttcaaaattaggacaaataggaatactgaatgcctaacccttcagcaatagttactagagaaaacagattaaataaatatatctgctctcaaaccctacgtattttaaaactaaattatctactaaaatagaaaaacaatagacttagattaatagcagctgtaacaccagtcaaataagcaattttgataaggttcataggtactatggtaataactaagatataaataca

SEQ ID NO: 2148 - DNA, 420 bp, Homo sapiens
  ref <308>: DATABASE ACCESSION NUMBER: Contig31596
  ref <309>: DATABASE ENTRY DATE: 2001-06-18
caatttgtgaatctatgattttttgaaagtaaaaatattttttaaagttctaataaggaatcaggaggtaagacctccataaaaagctttattattgaatgatacctgatctcacaaaaaacaaacaactaagcagaaaatattcttgaactaacccagaccctttcttcccatttgatgacctagtattgctggtaactcaacataaaattacatccctagggaaaaaaaataaagtcactctaaagagaaattgaaaatgagaaaaaggagagtaaactttaacacaatatgctaatatgaattaaattattagatatttaaaaaatctgaaatagcaacttaaaaactcagaactggacaaacaaaatgcagatgtgaatgactggctaaaatcaggaaaaaaattcggagaaaaag

SEQ ID NO: 2149 - DNA, 382 bp, Homo sapiens
  ref <308>: DATABASE ACCESSION NUMBER: Contig31864
  ref <309>: DATABASE ENTRY DATE: 2001-06-18
gctaaaaatttaccaaaatagtttgaacacataaaaatatttttaaaaaaacaaaaccaaaaacccagcataaatttagttgtataggcattggttagaggacactgttttcactaaggattatattcaacaactttctcttgagttgttactaaaattctgattctgaaccttatagcttataatggtgccaactattagaaatgggaaaatctaattcagtccaatgtaacatgtattatgatataatagatgaagggtatgtctacactataataaaaaataaacatatttttggttatttaaagaccatcttcctaacctgtaactaaaataactgtatttgatttaaacttatttaagtgcagtgaattatggaaag

SEQ ID NO: 2150 - DNA, 507 bp, Homo sapiens
  ref <308>: DATABASE ACCESSION NUMBER: Contig31928
  ref <309>: DATABASE ENTRY DATE: 2001-06-18
aagtttaaaaattaagaacaaatactttgatagatttcttttataactccttaatccatctagtagtttgcaagtcatgaactgacaatcttcgttcacctcaagtaattagatcttgtggtaccatttatatttcctttttataactatagataacaaattatataaagatgtgaacattcttcccttatcacctccccctctcccaccccaatcctaggagtatcctgagtgagcatgtatgccttcaaatcttttcatgtacattcacataaaatgtaactttaaagactcaatgtgtatattatacacataggtatgtgaatatatagcatgcatttatttaatttgttttgacaaaggtgagatccatactgctctgcaccttgctttgctcacttttcataggcatctttccatgtcagtacatacctacctcttctttttaatattcataacacattctataatgttatgtactataaccagtctctgaacatttaggtt

SEQ ID NO: 2151 - DNA, 511 bp, Homo sapiens
  ref <308>: DATABASE ACCESSION NUMBER: Contig31966
  ref <309>: DATABASE ENTRY DATE: 2001-06-18
ggtcatacaaaacgtagttgtgaaaggaaaagaaaatgccagccctgtttgacagacattagatttatgatcgttttttaagcctcaagtacgtcacaagaatcggcccacccactgcactgccctgattgtaaacacggccaagtgcccatccctgctcttcccctatcggacctgggctcctccgcttctgaacagcccttgtttccctctcctggtctctggtgggttaaaaagatgcctggctgtatatatatggagagcgtacaccatggagctctctgagctaaaacctccaagacaaacatagcccgctcacgccttccccgtctgccggcaggccgcagatgttaataaacatggttggggtttagggtttgcccactgattcctccatccattttacactcgacaagtcaggagagcattttttcccccttcccttaacgtacaaactcagtaaactgttgtaaggcttggcaacaaacttatgaattttggcctccagatg

SEQ ID NO: 2152 - DNA, 499 bp, Homo sapiens
  ref <308>: DATABASE ACCESSION NUMBER: Contig31986
  ref <309>: DATABASE ENTRY DATE: 2001-06-18
gcttttaaattgttttattacaattaaaattacacaaaagcaaatcgattcatttcaatcaaaataactcatgtttacatatttataactgtacaataaaatatataaaatgttttcatatttcatacttcaatcatcatcttcttcctcttcatcgctgatcacatacttcttatgctttttatttgctttatcatcatcttctgcttttctctttccggaaggttcaccttcctcatcactggtaagtttctttgctttgagtaatctttgagctttatcttcttctgatccctcatcactgtctgatgaatagattctggctcgttcctctcgaatgccccctttatatcggtttttaatggcagccaagctgatggactcctcgccttcctcctcctcatcgtatcgatcaggttccaggtaactggcgctcagccccgctggtgctgtttctctctcattcggcgctgctgagattcctacgtatggaagccct

SEQ ID NO: 2153 - DNA, 505 bp, Homo sapiens
  ref <308>: DATABASE ACCESSION NUMBER: Contig32084
  ref <309>: DATABASE ENTRY DATE: 2001-06-18
cccaatagaaaaattcatttcacagtcagaattccataagccttcatttcaagtgctgaaaagagaagttgacaagtttgaaaatgcccttcattaaaaaatacaatatcccagggtatacagagactcaatcaagttggaaaactattatctgtcataaaacagagttccacaggaagtcattctggttgaccaaattgaatgattaaattctcaacaaaatccatttaattggtgtgtgtgttgtgtcaggttttgtggagctgctttaagccgaggtgctccacgtggctgacactaaatcaatgactgatttagaacacactgttcagaaaatgatttagcaacacatgatttaacagtaaaaccaatcccctcttcagttgtgttttatgaataatagcctagttgcgggccccttggagagagaattgatcgaagatctattatgcaaacttgcccttttgtcaggactgtacttgccctcagattaaagcttattatc

SEQ ID NO: 2154 - DNA, 428 bp, Homo sapiens
  ref <308>: DATABASE ACCESSION NUMBER: Contig32105
  ref <309>: DATABASE ENTRY DATE: 2001-06-18
agaatcaggtggctcactgagctctgtattttgtttcctggagctttcactggtttcttcccctgagataccccaagtgacatgaaaagcatactcagggcctagagacactttactggggatgggcttctgtcacaggtcagaggtctgagaagaggggcaggcccactcctctccactagtagagaaaggttgacagagaatcatttcttgcttctcttggccgtagttttggttgtgctgggggcctcagccacagaggccttgggggctgtggctgctcgtgcccccttccttccccagaaagagctttggtggcccctgggaatcagactgcatggtttcttggtgggagaggaggcctggggtgaggagacggcctcagggactgtctcctccccttgcgcaggagtggcagaagggctgct

SEQ ID NO: 2155 - DNA, 376 bp, Homo sapiens
  ref <308>: DATABASE ACCESSION NUMBER: Contig32125
  ref <309>: DATABASE ENTRY DATE: 2001-06-18
caatttgtatttttctcaatataatgttgcaagatgtcattatattctcattacccataacttcccatccaaatcttaatggcacatttggtattttttcaaatggctttgagatataattcacataccacacaattcatgtatctaaagtatacagttctgtagttctgtggttgttggttacatccaccagactgagggctccctgagggttggtgcctcagctttcccttcacttactcattcaccaaacattcagcgcctactgagtactggggttatgatggccaacaggagagacagtctctgcctactgtttggtgggggtggagtacttagtaaccgtcgtcattattgagtgcttacctgtgctggg

SEQ ID NO: 2156 - DNA, 517 bp, Homo sapiens
  ref <308>: DATABASE ACCESSION NUMBER: Contig32185
  ref <309>: DATABASE ENTRY DATE: 2001-06-18
ttaattagagtttgtagtatacacttaactttctgtaatctgcagtgatgaatctctatgtaaacattcagaaaaagagcgaatactgtgtcatgacttatgaactataaattttgtccctgattactagtcaagaacagttttatacatttattaacaactactttcctccacttaacaacagctcttaaataacaaaataaattatcagcatttccaaccacaaatttaagaattaaagtttaaaaaactggttagtttcataaatgcaagcagagtaataaatttcatatatgttaattgcagttacttatgttctttgagtgaagtaacacaaagatttttcccttccccttttggcaagttcacaaaattcatgaaaagtcttcacctttttcttttttgcttaatttcttttttgcatctcagctgaacacaacagacaatagctggggttattagcgagacatgataaaagaaaaggttatgaccactcagacgatcatgtatacctaaa

SEQ ID NO: 2157 - DNA, 551 bp, Homo sapiens
  ref <308>: DATABASE ACCESSION NUMBER: Contig32242
  ref <309>: DATABASE ENTRY DATE: 2001-06-18
aagataaaaccatttaaaaacatctttttaaaatataacagaaagagatcacgaagtttctagtgagcaagtcatgataagtaaaaatcaactgtacaatgcccatgatttctaatttaagacagataaatagcaatgatcgttcttagcgtgtcctcttgaatttttagagtgaaaaacaggctttcattaagtccacatcttaatcccccaaccttattttccccctcaaggcctgaagttcctcaaatgtaaattctctcacaaagtcttttctgggacataagcccctctaccatggaggaggcgaaggctctggtttgtgctgtaatgcgaggagagaataagaatacagagccatgactgatggcaggagcactggggggcaggagttggagggttccgcatagacgtatttacctttctaagtgaggtacagatgagtttcagatgtgacacgaggcagcagccacattagacgtgacagcaatcccgccgccaagtttcccccgcttggaaagttctggagtccggagccgtggccactgggt

SEQ ID NO: 2158 - DNA, 403 bp, Homo sapiens
  ref <308>: DATABASE ACCESSION NUMBER: Contig32322
  ref <309>: DATABASE ENTRY DATE: 2001-06-18
gacattccagaaagttttctgcctccacaatctttcaaatgccaacacaaataggaaaagcagaaccccttaaagggacagctcaggttttctctggagcaacttgaaattaacagatttgctgttccaacagcggaaaatgcccatttcaacgttggtgagtgctgtatgtttaacatacggaagcaaaacgacgagaaagccgtaacacctaaccattttctacttttaagttgtttctatgactttcaagacaacagaactcctgggatttttctttaaccattttttatcatggaaacatttccggccttttgttctctagtgacattccaactccccaagcttcaaactcctgttccccgactctatttttaaaatctcgaaattcttgcgaaaaatc

SEQ ID NO: 2159 - DNA, 416 bp, Homo sapiens
  ref <308>: DATABASE ACCESSION NUMBER: Contig32336
  ref <309>: DATABASE ENTRY DATE: 2001-06-18
aagcagtaataaatggcaaaactacaggagcagtcaactatgaagactgagaagcctaggaatgaaattcagtactgatcaagtaaaagttacttcagagttaatgacagacaccaacgatacatcgatactgcaccaaatggtaacaggtatgacagaaatcaatcatcggccgcccacacacacgagtgggaaggtgacctcactgtccccaaatacagaatggcctcacctacctcctaccttcttctcatgctgttcacctctcccttggctcagcaccccttgccagttctcccaaggtcctctctgccagttgaaggcttccctgatcgccatcctcaatcccccaggactcacaggttgaaagagtcgcagccaagagttagggaacctgaccatgagccaatcccagt

SEQ ID NO: 2160 - DNA, 351 bp, Homo sapiens
  ref <308>: DATABASE ACCESSION NUMBER: Contig32558
  ref <309>: DATABASE ENTRY DATE: 2001-06-18
gatttttaaaagttttattacaaaatttttattttattcaaaatacacatgctatctttgtccacatttcaatccaaaccacccagtcacccccaattccaaaaaacaggcctttgttttataacatcgctgaaaacaagccatttttgacgtgggtttggagtcattattctatgacactcactctgccctaaggggactggattttgtaaggctgcttactgtggggatgtccacgggagtcagtgactctcataacagagtgggactgctttaggaaatccaagttaacattaggaggtgacaccagtgggcacactttggtagaaaagtactgcaccgtgagctccc

SEQ ID NO: 2161 - DNA, 608 bp, Homo sapiens
  ref <308>: DATABASE ACCESSION NUMBER: Contig32798
  ref <309>: DATABASE ENTRY DATE: 2001-06-18
gtttgcttgtttttgtttttggtgaagaaaactaatctgggcaaatagctcatgatgaaatttgaccagaaaatttctgaaagtgtccagtagtgtttttgtctctctgatcccactgagccactccttcacaatcttgggggctgcatgcccacctccaaggtatgagagcatcacctggcacttctgagaagcctcacacaggactcctagaggcctacctccagttgcttcctaagctgccactgtccacaggaccctctccccagaagctaaacaacttgccaaactaagaactaaaatctgtattttcaaaatatccgtgaagtaaagagagagaaaacaatcataaacttctttagtggttaatttttgaaaaagaaagattctttacttttcaacagctctgagggacaatgctctccccagatctccatcactgaaaatctattcaatctccagcacagataacttcaagtgccctaacatccacatcccaactgactgacgtttcttccttttcttagcactcaagcctctcacaggcctcccttgattccaccttgaatacatctgctgtcttgtgctcattaaccattgttagactc

SEQ ID NO: 2162 - DNA, 383 bp, Homo sapiens
  ref <308>: DATABASE ACCESSION NUMBER: Contig33005
  ref <309>: DATABASE ENTRY DATE: 2001-06-18
cagcctggggaatcccaaactatatctctagtaacaaggaaaccattttaccggaatttttattaacatggaaaagttctgtcaattaatcagacttcactgtccatatcactttcaaccttttgggaaggtagaaagatggaattctgaaactaaagttggtaaagttcacagagatcgtcaaacttgcatggtctaaggtatttcttctttctgtggttcatgagttagtaacagctaaaccaagtgtctaggaatattagctctgattctagaaatctacacttatttaactaaatgctgtaaggactcaggaaatccattctttcaacaaaagttactgaagactttccccattagtatcctaaacaatgtctgcaaaa

SEQ ID NO: 2163 - DNA, 404 bp, Homo sapiens
  ref <308>: DATABASE ACCESSION NUMBER: Contig33230
  ref <309>: DATABASE ENTRY DATE: 2001-06-18
ctgtctcaggactttcagggaaaacaatgttgacttaccaatgggcattttcaaagactctaagttggtatgtcagtcagtgtacagacaacgtgatccgcaaggcacgggcaccaccctgccgtgaaccacatctcagccaatcttccgcaaagaaatgtacccaaaaacttttctgtaaattcaggaaggtgatccacaccttccacattttgttttgaaacaatgatggtattttaaaagttcttcaaattaacaaaagtgatatcagaaatataaacatttctaaaacagagcgggctgtgaggagtgattttgccaaacttaagtcagtagcacttgacttatatctgcttttagtctgcggtggcaccacgcttaccaaggcacagtatccccttgct

SEQ ID NO: 2164 - DNA, 525 bp, Homo sapiens
  ref <308>: DATABASE ACCESSION NUMBER: Contig33260
  ref <309>: DATABASE ENTRY DATE: 2001-06-18
caaaaaaaaagtacctaaggctgaaaagtacaaatcacaggcatcaagaaaaagcagtttgtttgtgatgtttttcttactctgcaagcaagccaaaaatttagctaacacttttactgtattccactagattcgagacagcctgggtaagaagtgaccctggctgcccagtacaaacagctgggaagcccaaggagcactcaagaccaatgagatcaaaatccctagggtcagggtcccggcatcactaatttttaaaatatctcagaaaattgcaacgtgcagctaaggcagagaaacttcaagtgaaaaccaggctctttaatctaaaatgcaggaatgctgggtgaaaggcagtgacactggtgggcaagatttaaaaagaagtcaatctctctctccttacattttcttttttctggctcagagaaacatccaagtatcactattcccaacagaggacactgttcaccagagtgtgaatggtaagactgtgtctgtacaccaaccaagagcaaccatgct

SEQ ID NO: 2165 - DNA, 392 bp, Homo sapiens
  ref <308>: DATABASE ACCESSION NUMBER: Contig33394
  ref <309>: DATABASE ENTRY DATE: 2001-06-18
aaatagaactgtcttatagatttattaatgaaaaatactttacaaaaacagtatgtttggcctaaaatagttcagctgactctgagggtttacattgacgactgagcaagtggcaataatggctgtgttattgaggacagaaggctgtgttagtgtgcctgactccatctgttcaaaagggtgaatgttatgttggcagctccgcattctaggcctaaggtttggagggcacagggaatgctgacaggccataatacctgggcaggggggctgccctgatgatgtcatcagaaccatgaccacagggctacatgtccccccaaggatgggagacagggaagacaaagggtcaggtaatagggataggtggataaaacaaagagtagaagttg

SEQ ID NO: 2166 - DNA, 419 bp, Homo sapiens
  ref <308>: DATABASE ACCESSION NUMBER: Contig33654
  ref <309>: DATABASE ENTRY DATE: 2001-06-18
aagtggcacgccatcatttatttacagagaaaggtatcactttaacaaaatcaggagtccttcgggggcagattattctgtaataccactttcattatcagagaactctcgatacaaagtgttctacaaaactacaagaagaatcaggctagccttttaaggacatcatcaaaaatcaggcctacccaataaaggcagaggcagagctctataaaatttggtgaatccaggaccacttaaacaagtcagacatatagatgatggaagacatgggacgtgaatttcttttgctggctttctcattcctcctattctatcacttaaagcatttacctgccagcccccaacatcccagatctctctccactacccttggagagctcatttcttctcctggctccaaatcttgcccctgtaga

SEQ ID NO: 2167 - DNA, 503 bp, Homo sapiens
  ref <308>: DATABASE ACCESSION NUMBER: Contig33741
  ref <309>: DATABASE ENTRY DATE: 2001-06-18
cttgccagaagggttgatttttaattatgtgtatatacaaacttctctattttaacattcaacatattcaggattaattctagaaagatgctatagctgatttataaaacaaaatgatttaggatcagaaagaaaataggggcacacaatttcatgtagtctctccctaactacccccaaccatagcatcacaaggtttttttttttttcctaatgccacaattgaaacctgtattaacttaaaagttgacactaaaggcaggaattaagaagtcattttttatggcttttaagcacttgaatgctttagaacccccttgaaaatgctagtgaacaggtcttattcctttaaatgttgctttgatttgaatcttggtgaaatctagattccctattaaatagctgcatgctaattttggagaaagtacaatttaaaacctttaacaactactctattgactctgaagaaggggactttagcatgtcgctgtttgggctagaga

SEQ ID NO: 2168 - DNA, 438 bp, Homo sapiens
  ref <308>: DATABASE ACCESSION NUMBER: Contig33771
  ref <309>: DATABASE ENTRY DATE: 2001-06-18
gtgagattagaagtgactgggttttttttttaattaattataaacttattacattgattttttacaacagacataactaaacataaaacaaaaaggagcaaaagactttgctgaaacatcttcataggagtccagaatataaactgaaacagagcacatacaccagaaagaccttcccggaagattgtggaaccaggtccccagagcagaaagtacaggagagactcataactctccaggcccagtgctgggggaacccctcatgggagcagctgtaatgaggcctggaaactggacactgctgagccctgacatccagacctcaatgccctgactcagcccatggcagcgaccccttcaaacaggctccatgtgggcctgtaatcaggaaagactagagcatccaggagtggagatttgattctgagatgctgggag

SEQ ID NO: 2169 - DNA, 684 bp, Homo sapiens
  ref <308>: DATABASE ACCESSION NUMBER: Contig33814
  ref <309>: DATABASE ENTRY DATE: 2001-06-18
aataggtgatatgggtattttattttcttcaagtattaaagaattgttttctgttgggggaccgccttcattcatagccaagttttcacaagcttgtagtgggctcctaactctgtcaactttttgggaaacactaaatgttttattaacattctgaatatttgaaacccttctgttgtgacttgtagaggctgaaattttcttctttttaatggtatcccaaagactcctctttttctttttctgctcttctgcatttcctagtaatatagcttggtgtttcagaacatcatttacaagaaatgtcataatctctcttactcggccttctttgagtggtgtccagttaacagaaataacaattttctctttaggctgcaacacgaaacagcgctgcgacacactgaagcccaggtccgcggccgggaagtgggagatcttcacttctgccacctcctcgttagggttgtctagggccagagacagcgtccgtgaggctcccaggagaacgtccccgaagcaaaggaaaggagacctgcagaagtggctgagagacaggaccggcggggaagacgcctcctcctcggccgcggggccccgcagccccgcgggcggcctccgctcggtcgggctcacttcccagcagcctcgccccactcgccggttcgccatggcagattcgag

SEQ ID NO: 2170 - DNA, 450 bp, Homo sapiens
  ref <308>: DATABASE ACCESSION NUMBER: Contig33815
  ref <309>: DATABASE ENTRY DATE: 2001-06-18
gttaacattaacacatgctttattcaagagataatattcaaagagttaaatcctaagagttatccaccctacagtaaaaaggggaagtgggtaccacttatgacatgtacataaattccacttttatatttctgaataaagctgcaattgcttctttgatagagccatttcttaaaacttttgctaataaggctatgtgaactgtgttcagaaactttgacaacatgcacactcactcctctcaaagtcagtacccaggattttcactccaggctgagtacctattaagtaactaggacttcagactgcatgttactatatgaattcaatttgactcacctccagtatgtttatctaccacaactattgtttaaaataatcagatgaatgtttatcataactttataactcccccaaattatacttcagtatttaacatggtagtttcaa

SEQ ID NO: 2171 - DNA, 431 bp, Homo sapiens
  ref <308>: DATABASE ACCESSION NUMBER: Contig33833
  ref <309>: DATABASE ENTRY DATE: 2001-06-18
attcatgagggatctgattttattttctttttcaactttaatttttgattcagtgggtacacatacaggttttattacctgagtatattgtgtgatgctgaggtttggtgtacagataaagcgatctgattttatactcttatgcagtggatctaccactactacaatgactgctacagggctgctaatgtttctgaatattgtctaagtacttctagaaataggaaagaagatcacagaatcataaattcttctatcttaaaggagccttcaggataattattattttacaaaaaaatgcagctaggctattgtatacatcaaacaggctgttttttctcatggtgaactgaatctgcttcagtggaactttccccattctgtctgaggtctccctttggacacaatgtagaataaatctattgctctcc

SEQ ID NO: 2172 - DNA, 403 bp, Homo sapiens
  ref <308>: DATABASE ACCESSION NUMBER: Contig33998
  ref <309>: DATABASE ENTRY DATE: 2001-06-18
gccaaaggaagcaagctttattgaatttacaacgtagaaaatatttgtagttccttagacatttgcattgctataaaaattacactttatggtataattattaaggtttgaagagaaataaacagtataaacgaaatatggcccacacaatgaaaatgtaaaccatataaatcaaaatcataaaacaattattcaatactcagaggcctacttaatatatacatatgaaatttcttacacacacacaataaatgcccacaaaaaccatcactgaagccgatcactgtacaaatatgaaaataaatctttatctttaacctcaattttatcttcagcaggagggttgtgcaacttgggtttatgcagatcacatcaagtgttaaataatcaaatgtcacatatg

SEQ ID NO: 2173 - DNA, 405 bp, Homo sapiens
  ref <308>: DATABASE ACCESSION NUMBER: Contig34079
  ref <309>: DATABASE ENTRY DATE: 2001-06-18
aaccgcaggaaagtacatttctgttgcttaggccgctcagcctgtggcactttgttacagcttctcacccagttcaggcccttttaattgattgctgggcctttgcagttgtttttgcttctaatatattcatctctcaatttatttctggaggctgccacccgaggggcagaacttcaattgtgtccctaatgggaaaccttgctgggatcatgtggtctacagcacaaggttgctaaagcatcttctgccagaattctgtgagtatctggttaggtgggtctggaatatactgagtttaaaaaagttaaataggtttctttactgcaagatgtttcagagactttaatatgctactctgctgtatgaatctccaggcaggaaatcttataaaatgtgtttctg

SEQ ID NO: 2174 - DNA, 386 bp, Homo sapiens
  ref <308>: DATABASE ACCESSION NUMBER: Contig34080
  ref <309>: DATABASE ENTRY DATE: 2001-06-18
ccctgagcgaactgcatccatataatttatttcacagggactttatttcttgccatctcacatggcatcacactggtccattatgctgatggcaacttgtgaaaggaagcaccaggcatgctctgggggcagagtggggcttccaaggcctcccgagcccagcgggcctggctggctctcaactgttctgctctcagcccctgtggggctggcatggggctggacaccagctctcctccctcttcccagaagcacccgcatggctgtggcagctcacacctaggcctccagcatgtccagaggaaagcttcactcctggtgggagtccaggttagctgaggatgggatctcccacgagcggccacaatgggaccctggcacactct

SEQ ID NO: 2175 - DNA, 372 bp, Homo sapiens
  ref <308>: DATABASE ACCESSION NUMBER: Contig34222
  ref <309>: DATABASE ENTRY DATE: 2001-06-18
aagattgatttatatttaatgtaatgaggcttttctagcagcatttaatacatcactcaaagaacaagtcttaactgagaagtacagaatacctcattttcacagtaatttttttttaaagtcccagtgatgaaaactataaggcagcttcctcaaaggaagttaacactgatgaatccagtgcagccggtgttttccatatgaggtgataaaatctttatcacatccagctggactgtcctgtatgttagtctgagtctttggaacagttattcctttttattaattgtatggttgttatgcagccatggaaggaaaaagctgaacatcaaaatcatcaacaatatacctaaagaaggagccagccagtat

SEQ ID NO: 2176 - DNA, 530 bp, Homo sapiens
  ref <308>: DATABASE ACCESSION NUMBER: Contig34233
  ref <309>: DATABASE ENTRY DATE: 2001-06-18
gacaggcacatgtttatctagcggtcagtagaagtcacaacccaggcatccaaaccagttagtatgagttattactaagtcaggtgaaaagagctaggtggttatacatttgatctcttaaataacacaggaccaccaaataaataataataaaaaggcacattgtcgttttcatcctggggaccccagtgagagtagggacctcaggtaggctccttggaattggaactgttgtcctgaagagggcaagcctctgtttaacactctgaatccagggcttgctgcaaccctatgctaggtgactcaggcctctctcctctcattacaggctggctaaccgcacagcctaagttgaggagcacatgagctgtcatgactgtatccagattggaattcatcattttcaatgtcttgcccttagaatgagtccactgagcaatgtgaagttggcggtgtccaggaaaacctcctgctgttccttctgtataattcctcttctttaggatttctggttaggaacacggacgggt

SEQ ID NO: 2177 - DNA, 437 bp, Homo sapiens
  ref <308>: DATABASE ACCESSION NUMBER: Contig34303
  ref <309>: DATABASE ENTRY DATE: 2001-06-18
gctttaaatcccgtatttattgcccaaagctcattagtattacacaaatcacatagattgagaaattttctgaggttaaaaagacgctgcaaaggcccctgggagtggctgaggcttgcgtgcgggggcctcactctcactgggccaggcttgaagaccaccctgggtctgtccaccagcctttttcctcctctaggctcctgcccttttcccaggccagaggccagaacaccaaagaagtcggctcataaccaggtgaaaggggtccgtcggccagctcgactccacggccagcttgacatcttggtccctgcaccctcacactgctgtctgggaatggaagaagggcatccccaagcctgagggcatgtttgaagtgaccagaggagggccaggcagggacaccaggggtgcagcaccatcgcaggcgtggcttg

SEQ ID NO: 2178 - DNA, 393 bp, Homo sapiens
  ref <308>: DATABASE ACCESSION NUMBER: Contig34393
  ref <309>: DATABASE ENTRY DATE: 2001-06-18
aacaaagttattggttaggcctaagagacccttggtatatcacctgaaatcttggtggaggttgatattgatttattactctaagtttggtatgcagactgttactggtctaagaatgagataaggagtttgtgccacaacgtaaaataaactaagacactaagcacattgcttagttctactgacatttttcaatgaagaaagcagtacatggatttatattctggttcaggttccttgtgccctagaagaccattaaaaacagtttgtggacaggttactttcagtagtactgctatagttgacaactgccatatccatggctgtctatcaattctttgcatagtcttcttacatttaaagaaatttccattttatgagtttcagcttccc

SEQ ID NO: 2179 - DNA, 443 bp, Homo sapiens
  ref <308>: DATABASE ACCESSION NUMBER: Contig34477
  ref <309>: DATABASE ENTRY DATE: 2001-06-18
caaaatatgccttcttaatcagtggccctgaagagctctatgttctctcttaaggaccaatttgctattattgttgccaagtaaacaaaaaataccaacaagaactaagcacagatgagactttcctccaagaatcaggatcatcaagtattaaaatagatccctgaatagtttagagaataattggattatactctctcaaaatccctaaatcattctacttctgtaattgtatgagctactctatttttcccgtgactttttcctattgcccaagtttggcttttcttgacagcaggattctactttgttggatgctctttgaaaaagtctgtatttaatggtttttagaaaggttgtagctttcatccagcatttgcaggctctcagcttttgcttaaggatgaatgcgtctcaacacagtctcttctctttgtgatttc

SEQ ID NO: 2180 - DNA, 443 bp, Homo sapiens
  ref <308>: DATABASE ACCESSION NUMBER: Contig34634
  ref <309>: DATABASE ENTRY DATE: 2001-06-18
gcctgacaaaactggacatctggatgtccctccagtctacttatatactcacagagagaataagtttaaatattaaagagaaaacacaaagatacttggaataaatgtgcatttaaaaccctgactaaaatatcaacataatgatcataattacaatggtaataaaaataattagtacaataatattatctttatgagcagcatggaaatttcattcctgatctggaagaataaaaggaaagaaaatgtcaggtgaaagagtaagtagcctccaacttaagcagacagaataattttctttaaaatgaaaagaacattttaagctgtctttccccctaaaagatcagatctagaaagggctggaaatgaactgtgcccaggaatctgggggtgctctccagtaaggcgaactgaggctcatttgcagccaagacttggaactc

SEQ ID NO: 2181 - DNA, 464 bp, Homo sapiens
  ref <308>: DATABASE ACCESSION NUMBER: Contig34766
  ref <309>: DATABASE ENTRY DATE: 2001-06-18
caaaagaaaaaataaattaaatttattaaagttttaatacaaagcatcccatttgaagtatagttctgaagaaatgtttatgagctagggtcctgtcaagagaatattctatggcaatggctcactctgtttgtgtactcttacagatcctctcctgaagcaacagaaagaggtgtagattgaatttaaacaatatccaacgaaaccttcattgtatttgtttcatactttttttagaacgtctcaaatcctttttctgcttgaaaataggagaattcaaaaaacacaaatctgtaaaagggtcccctcttctcagtttcgaagcgagggtgggctccttatagttcacgctggctgtgcacctacgtttaggcagagccactgctgggcttgctttattcttttttggagaaagagaaagtcttctgattttcacaacaggatacaaggagacattggtgata

SEQ ID NO: 2182 - DNA, 484 bp, Homo sapiens
  ref <308>: DATABASE ACCESSION NUMBER: Contig34952
  ref <309>: DATABASE ENTRY DATE: 2001-06-18
gggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtagtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataata

SEQ ID NO: 2183 - DNA, 387 bp, Homo sapiens
  ref <308>: DATABASE ACCESSION NUMBER: Contig34989
  ref <309>: DATABASE ENTRY DATE: 2001-06-18
cacgtaaaaaataaaatttatttctttttacacaagcagcaaggcatgccctatcctgacataatttcattccaaatggaaatcagatcaaggccctaaagacacagtgtgaaggtgagagggttgccttggccagcctggcttggaggggatgctgaccgggccgccttcctcctgcagctctgacctggtcattcccttccaggagtgacgccagctcccggaggtgctccagctgctggagacgattgttcgaggtgaggaccagcctgtgcacctcctcatccactcggtcgtacaggcttgtggcggcctccagggtgtcccggctgtcttctgtgccaagctcttctctcctcagccgcgccaggacggtgcccccctcca

SEQ ID NO: 2184 - DNA, 419 bp, Homo sapiens
  ref <308>: DATABASE ACCESSION NUMBER: Contig35030
  ref <309>: DATABASE ENTRY DATE: 2001-06-18
gtcggttaatttacactttatttttttaaaaagttgatttaaaaaaagaaacaacacaagtttagaatccataaaatgtcagcaatgctgatgtgcactggactgaaacatcttgatcatcttctgatagaagtaatattccatacaaaaagattcttagattccattttttgcttcattattgtttgtggcttgctttctttgagcaataaaggggtacatacacttgtccgctcctaggaaccgatacatgcacacaactgcttcaaatggtaggatgctcttcatgaaggtcacgatgtacatgaggcggggagtgcagatcatgggctggtcagtgaggatggccttcatggcctgcttcacacagtaatcaggcttcagaggtggcagaaaaggctcaatttctttcctgattc

SEQ ID NO: 2185 - DNA, 668 bp, Homo sapiens
  ref <308>: DATABASE ACCESSION NUMBER: Contig35251
  ref <309>: DATABASE ENTRY DATE: 2001-06-18
ctatacagtatttgtcagctgtttttattcttcagtttatcatcttatatttggctctcaatttcacccataaattattgatggcttattatacgccaagtaccctgcgctccgctttttgtggtatccctcttcggagcgagaagtcacttagaattttaccccatcttccccacttgggaatcggaagggttcatagctaagttttgttatttataagcacgccggctcttctctatccctctctccaccaaccccatttcaaggttggtccctcccagcggacgacagtgatgaattcctcttggggacagccctcccgcaactaacggtggctccatcgacgctctggtctccttgctgctcgctgggaattcgggtgggacgttttccaaagtttggattccacggcacattcctccctcggaaaggcacaaccggctcggcgtgtcagctcagctggactcacgccggtgcggggccgcagctccggttctcgctgggcggctgcggagggctgggcgattctctcagcgtcgcgaggcgacccgggcagcagcaaacttctccgcttcccctcttcgggacgcggcacctcttctgcccttgagcactccgcaggaacttcccccggcctcggtctcgctccgaaataaccgagccagctc

SEQ ID NO: 2186 - DNA, 400 bp, Homo sapiens
  ref <308>: DATABASE ACCESSION NUMBER: Contig35629
  ref <309>: DATABASE ENTRY DATE: 2001-06-18
cacatgccatttatttttatttgtacaaatttacattaattttactacatacatatatattttaagcgttcataacaaacttagaaaatagcggatgaaatccagtacaccaatcatctagtcttagcaaatactattattttaccataattattccagatccttctttaaaaaaaaaaatgttactaacataactaaagtaaccaaacataaccaccaaaccactgtctcaccccaatgctatccacttcctgccttattatactaacaatatcctgaagcgtatagaacttttagttaatatttttatattttaccacacatgtctatgccattaccaatatagataatgttctttggagtttttaacttacataagtgagaggatactgaccatgtt

SEQ ID NO: 2187 - DNA, 426 bp, Homo sapiens
  ref <308>: DATABASE ACCESSION NUMBER: Contig35635
  ref <309>: DATABASE ENTRY DATE: 2001-06-18
actttcaaataaggaaggcaatttattgtagtgaaattacattgaagttttatatatgacccccaatgcatataaaatcatttacctccacattataggataggatatcatgaactacaaagatactcaaagtgctatagatgagttaatattgatgtaatacattttcattaatctacccacatttaattggatgattgaaaggacacgttgaagtgtttttcatgatttttgctacggccccagcttttactggagtttttaatgcctttgatgactccagacactcaactctgttccttgcagtctgtttctttcttctatggtggtgattagttattgcaagactgcttatatagagtaatatatagtttactctggtatggagtaaacttataccagagatttaaacatttctccctaaat

SEQ ID NO: 2188 - DNA, 429 bp, Homo sapiens
  ref <308>: DATABASE ACCESSION NUMBER: Contig35763
  ref <309>: DATABASE ENTRY DATE: 2001-06-18
gaactcgagattatttttattatagtcaatgtttttcacacacacacacatatatatacacacacacacacatctaaaatgagtcagattctctgattactcttatgttcattatgtaaactccagtttagaatatttcatctatttaatctgcaatttctagtatattggcataggtttgccgcctgttccattgttagttttggaaaacgtgtgtacgatctgtagggctgtctgctggctcactcccatatggaaatgcatgcctgctctttctttctctttttcattgtagttagaattcatgagtgtgattcatgttttcaagaatgagcttcactggctttgttgaattttcaagctttggtttttcctcatgaacaactcctcttattattgttattattccctttcttacgccttcatttg

SEQ ID NO: 2189 - DNA, 401 bp, Homo sapiens
  ref <308>: DATABASE ACCESSION NUMBER: Contig35814
  ref <309>: DATABASE ENTRY DATE: 2001-06-18
gataggctcagcagcatttattttctagttttaagaaaatttgattattcttgtatgaggtctaaagtgtgtatctatcagtccaatcaagcttttaaattttcggaaatactaaatttctaaatcataaagcgtcatttaaaaataattaattgtttcagtccaaaaatagcgtgggtcaaactggaattttcaaagtgacgtatctgtggatgatatgcttatggtaccaaaaagactctcaaaaaccaatactcccacgggcaagggaatagccaagtttgttgcggtttccaatgaatgacatcagccctgtgtaggtctcaatcaaaatgggttcagttaacaccatcagtttctttcctcttccagatccagttgaattcttgtgggcattctgg

SEQ ID NO: 2190 - DNA, 496 bp, Homo sapiens
  ref <308>: DATABASE ACCESSION NUMBER: Contig35896
  ref <309>: DATABASE ENTRY DATE: 2001-06-18
aaggagtttctaccattaacattttatttaaaggctttgggactctgaagtataatgtttgtgaaatgctatgagccagaccctccacactgaaaattcccagtgtaaattaatttgttaaatgctcttagaattcctgcaataaagaacacctatctaaccttagttatccctgtgtttcccaaatatatcttactttggagcactttttttttagtaccgatttacatcctgggaaatggtgtttaccatgctttaaaaaaaaactgtggtaaaataaagataagatttaccatcttaaccattttagagtgtacagttgagttggcatacagcattcacataacttaactgtgcaaccaatccacaggactttttatcttgcaaaactgaaacactatacccattaaacaactcctcatttcctcctcccccagtccttggcaactaccattctacttgtttctatgcatttgactgctctagatacttcaca

SEQ ID NO: 2191 - DNA, 390 bp, Homo sapiens
  ref <308>: DATABASE ACCESSION NUMBER: Contig35976
  ref <309>: DATABASE ENTRY DATE: 2001-06-18
cagattttagaatatttgcatcatacttaccagctgaacttcccaaatctgaaaatctgaaacctaaatactcaaatgagcatttcctttgagcatcatgtgttgctgctcataaagttttagattttggagcatttcagatcttcagatttaagaagctcaatgtgtaatttcaacaaaagacttgaacaaaaaaaaaaatttatgtgatactgactaaatgtccaatttgtgatttgccaactacctaaaaacaaagggctgaatgatttagtttatttcagtttaaccttctcaatataaagattatttaacctctcctttagttattctttaacaaacaggttacacaaaaagtacaattacttctactaaattaaatatcttacc

SEQ ID NO: 2192 - DNA, 486 bp, Homo sapiens
  ref <308>: DATABASE ACCESSION NUMBER: Contig36042
  ref <309>: DATABASE ENTRY DATE: 2001-06-18
aaactagaaccaaatttatttatcagaattattgagttggatgaaacagaaaataagccaacagaacacttaaaaatacaagtttattttctccatattgttaagtctaattatgatttatttcaaaatcatgaaaagcagagcctagcataccaaatgctaggtcagatttgctctggaaacttactttctagattattttttggacttacttaaaaaataattaatttccattaatatagcactaatagcctccaaattatactgcagaattcctatatgtaaccttttttaaaaaaataattcatcacctgaaaaagatatatttactacagttaagtttttaagtcaagagttttctctgggaattgatatattttatctataatgtctccacttctccatactttcatcaaagtgtcactgaagcagctaaatgcagtcctgtggggctaggtctacaacatctgcttaggtttattttag

SEQ ID NO: 2193 - DNA, 420 bp, Homo sapiens
  ref <308>: DATABASE ACCESSION NUMBER: Contig36081
  ref <309>: DATABASE ENTRY DATE: 2001-06-18
caagtacaagatgttaccactgacaaaagggtctcatatgaatgatggaggtttctgttaccgtatgcccataaaggggcctgaaaccaaatatgatttgaatagaaaagaccttgggaaacataagtagcactttggggctaagctgcgaaggcactcgtattgtacaagtaatttcgaagagagcctaaatttgctacccccctgcttctacagggtataccagatttttgctgtcttgggacactgagctcatggaagcctgtggaggaaactaaccggtaagctggggatctaggtagtcatccaagagtctggagggagaagaaatttgttacttccacagctggggtcctgtagaaccatactaatgtacaaatggatgctgaaaaatacctgcatagtttcaaaacaaaactc

SEQ ID NO: 2194 - DNA, 495 bp, Homo sapiens
  ref <308>: DATABASE ACCESSION NUMBER: Contig36152
  ref <309>: DATABASE ENTRY DATE: 2001-06-18
atgaataaccaatgtttacttcatacaggagctacttaaggaggtcactatatctcaatgtgaaaactccaatgaatcagtcactgtgttcaactgaaaccaacctagagaaccttatctctctgcataaaatgctcctgctgcatggtttttcagggccattgtgaaattctgtgatgggggaacaggaaatctggacacagaagggtgggactaaaatgagcctgtgccgcttttttttttttttccatgcctcaatgtcgtcatagtcctggggtttgtatgcagcatctcaggaccagaagagcccattgggaacctccatctcaggccagagcatctgtctggccttgtcgctgagggcgtggggctggcactgacccatggtaggttgcctgcatgagggccgtccagccatgcacgctgtcctgcttgtcaacatccgcgtgcctctccaccagcagctgcaccagagccagctgccccgtaacagct

SEQ ID NO: 2195 - DNA, 427 bp, Homo sapiens
  ref <308>: DATABASE ACCESSION NUMBER: Contig36193
  ref <309>: DATABASE ENTRY DATE: 2001-06-18
ggtcctagataggcttagttgtactattcttcaaccggcccttttccctcaaatggggaaaaatcagaaaccagagagggaatggcgtttccactgtttctctctttgtgactttcagaaccaaggtatttagtactcgatgctgttgggattcacttcttagcttggagcaaggaatcttcattctgtgtgacctaacagttcagaagctcctatcccctcatgagataccttacgtggaagagaaaggttggagttctgcatcgtagtcagcactagcaacctgggtcattcatttaaagaactatctttaatatttactctcatgactaattgcccatgtgcatgtgccaaggcaaaacacaaaagtgactgtttccaaatgactgtcttctgcttttaattcctacttgccttcagttctaac

SEQ ID NO: 2196 - DNA, 433 bp, Homo sapiens
  ref <308>: DATABASE ACCESSION NUMBER: Contig36312
  ref <309>: DATABASE ENTRY DATE: 2001-06-18
cagacttttggcttgtttgaaaccagtaactggaagaagacactgccggacctgaggattgcacaactccgggaaagtcacctcattccactgataacagaaccaagcgtcagcaggctttcaacagcccggaactcagctaaaatctgcagacctcagaaccgccagcagcacgaggacagagtcggggaggtgtagctggacaacagctcatgaggcagaagagctgtgtcacaggtgtcagctgagcacaagccctgtctgaggccgtggtgactggcgacagccgggcagtggagggccttggaagctgaagggtggtcttggcatggactctggtccttggggtgcaggctcttgggtcccagttctgctcggggtggtcctgtgaagcactagactcctagcgggtcatctgggaggttctagcaga

SEQ ID NO: 2197 - DNA, 441 bp, Homo sapiens
  ref <308>: DATABASE ACCESSION NUMBER: Contig36323
  ref <309>: DATABASE ENTRY DATE: 2001-06-18
gtacgaaatgtgttagaactcctcttgcctatgttaaaatgtgaatgggtcagtctccctccactgtaggttgagcactctcccagggggcccaggactgctggggttggcgtgctgctccctgcaggtgcagccgtgagtctacggccctgcccctcagctccccggctgcacagtgctccgtccccaggccgctgaccacactcacaaccccttgttgtacaccactgtccggctgctcgtggcctgggctatctccggctctaattgggatgtttcaatctctgacatttgcgggaagaggctgatggccagcggcagggccaggccgaaggctgccaggcacacgaggctttgcacagggaggagcagccgggggcgtgcctgcaggagagccgtcttctccagcatggacatgacgatcgggggtagcaccaggat

SEQ ID NO: 2198 - DNA, 435 bp, Homo sapiens
  ref <308>: DATABASE ACCESSION NUMBER: Contig36339
  ref <309>: DATABASE ENTRY DATE: 2001-06-18
ggtggcttaaagaacaggcctttattatcatgagcaatgtgaagcaggcagttccagagctgggtgacttggatattggatatatccataacgagcatcatatgaaatcaatcaacacaggtaagtctctgcaggctatttgcagaatccttctgtgtcctcttgaacaaagctgattatttccatgccatttacatcaaaagagaggaaattaagacccctagtgggctgtgagaccactcacaacaccttttagggactggggagagaagagaggtctgcccgtcacaagcatgctggggtaaatggtaaacgcagtatgattctgccagatggtaggagcagatggctcctgccccagcaaaggccaatagccatttaaaaagtgcaacacagctgctgaaagcatctcacatacttggcactcacagggaa

SEQ ID NO: 2199 - DNA, 485 bp, Homo sapiens
  ref <308>: DATABASE ACCESSION NUMBER: Contig36647
  ref <309>: DATABASE ENTRY DATE: 2001-06-18
gacacacttacttaatgtgtttattcaaagtaagagtctttatagatcttttcactaattaaatacagttgggtgtctgctgaatttcccttgaaaacattttgaagtgaaaaaagtcagtactgagtactgtacatttgtgttgattaacatttggacacaaatatacttttaacaccaatagagctgaaagactatgcctttatcttggatttcatagatttccccttccccccagtgacttatcttacaaggcaaacaccagcaggcaaaggggatctgtagaaatgtgcaccctggtttcctcctccatctcttctaccaatgtgggaagaaagccaatgcttcccagcactttctgaaggtggaatctcctcctctttacttaatgttggagaaaagtggccaccagtactcgatcattgtagattcggaatctcgccatctaaaccagacttcaaaagtgcactttcgggtctacttag

SEQ ID NO: 2200 - DNA, 462 bp, Homo sapiens
  ref <308>: DATABASE ACCESSION NUMBER: Contig36744
  ref <309>: DATABASE ENTRY DATE: 2001-06-18
caaacaagagaggctttatttagatcaccaaaaagaacattttacagaaagggaaccgtaacattacacaaaaaagtatagctgtaaaattgcaaacaagaaaggcaatgctttctttagatcaccaaaaataatgtttcacagagaaggaaccgtcagaagcaaattatagctgcaaattttcttttgccatcaatatggattccctctaaaatactttgagactactttgcagttttcaagtacaaactaaaccttgttggacagttgctcagcttcatcaagagaatgaaaccaatttgcaaaaaaaattttgtttaatgctaacaaataacgaaacaatgtggttcttgctgactaactgcaatgtctgctgaaatggcctaacctatgtacacttccatgaacatttcactgtgaacagttgctttttacctgccatcacagatggcctacaaagta

SEQ ID NO: 2201 - DNA, 470 bp, Homo sapiens
  ref <308>: DATABASE ACCESSION NUMBER: Contig36761
  ref <309>: DATABASE ENTRY DATE: 2001-06-18
gactttgcaggatgtgctttattttaagtcagccctgaacccaaactacacaggatcaatttttgacatattctagtccattcaatgattcttctcagaaactgtatcttaatatggaatgaaaactacatttcaatcataaatttttcatgctacattgttatttaatgaagaggttgtattaccaataataataatttaagaaaaggccatttttatttccccaagctcaatatacatatttctttcataattatgaacttaaaaaacccgtctcagatgtaaaaatgtgaattggaatatgtaaactctttgatatacctgaaaaacaggaaggaaaatgtcacatactggaaaaaccattgccttaaatcatggaaatgggaaaaagcacgttaagggaaggggaaggcagaagagcggtcctgacctcagttattaaagagttacaaagtattctaggtcccact

SEQ ID NO: 2202 - DNA, 425 bp, Homo sapiens
  ref <308>: DATABASE ACCESSION NUMBER: Contig36879
  ref <309>: DATABASE ENTRY DATE: 2001-06-18
aaatgaatttaatctctctctagaaacagtgcactgattttacaaatgtccacatttggttttcagtttaccaagatgatgccagtatagctagtgagatgcagcaccccatcctcagccccctcgcctctggaagagacaccagactgcaaagggcaccgcgtacagaagctaacggaacttgaatgacaagacaaaaagagcagaatcagttagtgtgacacaacattctaacatgcctgattcttacatcaaatatggtaactttggggttggtagggggagacaaacaaggagaatccacttgggaacaatttgatgaagtttgcaaatcagcactttacccccaaattaacaacagcttgtatggaaaaaaaaatgctcttttaaaagtatatggtttggacaggtatatttgttttctc

SEQ ID NO: 2203 - DNA, 654 bp, Homo sapiens
  ref <308>: DATABASE ACCESSION NUMBER: Contig36900
  ref <309>: DATABASE ENTRY DATE: 2001-06-18
accatcacttttttatttggcagtaatagtaatacatccatgttacagtgcttattttggctaaagagccagtgcaattttttctgctactgtagtgttttacttttacacaaattaatgagtacagtccttacatttaggagacagaaacatttactgacatcagctaagtaaagctaatacatggttgttcacaaactaaacaaaacaataacataatatactcattaggaacaaagtagggatgttcttatttccactaatcacagattatataaattcttaaatttcacatacatatttctaaatctaagcaaaaaaattagaattcagcttaattcctataatcattttgaaatttacatcaaataatttctgaatatatattcacattaaaataaaagtaaatgggttatataaacataatttaaaatttctgattatgaaaagttatagagaagtacattaaatgttactttggcattcctatttcctaggcttacaggaattattaagaattcctttgtaatgcaaataatcactctcttggaaattaaatttaagtagaaaatgttacattttaaggcaagaaaacatttgtaaatatttttataaaggcatttaattcaacaaattaacggaatcatagtaaat

SEQ ID NO: 2204 - DNA, 846 bp, Homo sapiens
  ref <308>: DATABASE ACCESSION NUMBER: Contig37015
  ref <309>: DATABASE ENTRY DATE: 2001-06-18
ggtttgattgtcatttatttcttttaaataaactccctctaaatgcaggaagtaagtataatgagaaaccacagaatgtggctctccaaatttcctcagtagccctacctatgtattttaaattatcatagaaaaacaaacaaaacgacagcacaagtagcagtgcagccatgactgtcatcatttatattagttccctgacttactatacatccctggtataattgatgcatttgtggatgttccattatggttgacacgtactgtaagtgtacaacaacctgacccttggtatggtttgcaaacatgtccatattgcacagaatgaacttcttgctgcaaataatatatctaacatacatcctttcaaaatgtaacatccttaactagttaacatagtctagagtctaggggcaaagacaagcaaatattgatgatttagaaatgcagtagcacgttaggctacaacatggttaattccaagtcacttcatattttgcaagttctttgctcctatgattgaatacttcaaacatgtatcttatctttcctcctgagtatccaaaagtgctttggagagcaaaagtgctttgtctccccatttcacagaagcaaggaggggggatagggctgtagcaagaagggccagctgctctagagaaaatgtggcagtaccagggtaaatgttagcatccttaagcgggtatcttcagccagcaacactggtgtatgggggctagtgacggtaggatttcatgtgtaacctaagaacaactctcttcagggcatgttttctaataatcttaaaaggattcctcagcttggctctacctaactggaaaatgg

SEQ ID NO: 2205 - DNA, 501 bp, Homo sapiens
  ref <308>: DATABASE ACCESSION NUMBER: Contig37024
  ref <309>: DATABASE ENTRY DATE: 2001-06-18
aatagccacactgattgttcatttctttaatttttaaaaatgagtaagcagacaatcttgcaccctttgaatgcccaataaaaatgttcattatgcaaaacagtacaacctttttcattttttaataatactgtaaatatctcagaaaggatgtattgtttctaatgaatatcaaaaaagtcatcacaatgacatgttcccctgcccccacattgccctccccacccccaaagttacccaaatactagtaggaaattacaaaaaacaaaaagcaacaatccaccctccgccctgccccatgagtagtgttaagtgagtcaagcgttagccacattacgacgtgtgtgtgtgtcggcgatggcggaccacagggatctgtgcatccgtgagagttggtgtggagaaccggtagcagcagcagtgggaagcctccttgcctggggcctgctgggaagacagcagccgaggataaacacaagcagggccccagcctggcccttc

SEQ ID NO: 2206 - DNA, 387 bp, Homo sapiens
  ref <308>: DATABASE ACCESSION NUMBER: Contig37063
  ref <309>: DATABASE ENTRY DATE: 2001-06-18
actaaaatgtctttaatgagagccttgaatcaagtaagcaaagtaggtgatgcccctgaacgggcctagctcctgcacagtcacagtccagccataggacccttgttccaggcagggcagtcgcacatcagggtcctcatctgagaactgaatcagggtcccctgagggtttagaaccctcaagcattctgatagaagctggtaagccctaggcagacctccccgggcaacagcatcccatgtgcctttgtccagcagtagttggaaagagcctgaagaagccacagcccccaggttctgagcatcggcgtgcatgaagtggaggcttgaggcagggtgtccagggcatagaggtgtttggcttgggcaccctccaggaggctattc

SEQ ID NO: 2207 - DNA, 420 bp, Homo sapiens
  ref <308>: DATABASE ACCESSION NUMBER: Contig37072
  ref <309>: DATABASE ENTRY DATE: 2001-06-18
actttcccactactaacacatcccaatggtagatatgtataagtgaaatgagtgcgttcttcctgcccctataatgacaagcctgacagagaacacatcacacagaagaatgtgccaagaatcaagacctcttagaagaatgttagaaagttttctctccaaatggattctgtctaagtaggaaggccttggcaactagaaaggtctaagatcaaatttatgacttgaaaactctatggctttgggcaaattatctgaacttaattctggactcaatttcttatctacaaaatgggaattaaggcatcaacctcaaagggttgtttaaagaatgtgattatgtatttctgtaaagcacattgcaaagtatctgacacatagtaggtactctctgtaaatattagcttcacttctctcact

SEQ ID NO: 2208 - DNA, 406 bp, Homo sapiens
  ref <308>: DATABASE ACCESSION NUMBER: Contig37140
  ref <309>: DATABASE ENTRY DATE: 2001-06-18
tcatatcacagtagaaaatataatttgttctaccatgggaaatagtataatggaatagatcacaatagtagtataataaaatagaatatccaagtgcaaaaacaattttcaagtaagtacacacactgtttgaaggtactttattaagatcaaagatttttcattacatttatttataaatccttcctagtcaaaataaaataataaaaatctgtatctttagaaagaacatagttttgtaagtctgagaaggttatgtttgtcagtttcaaattattacagtttagatacattcaatcattacacaataccaggaaggtcagccttaaagataccaagaacttccatattggtcagtaaaataagggtaaaaaattaaattttactttcacctttttatgtttga

SEQ ID NO: 2209 - DNA, 447 bp, Homo sapiens
  ref <308>: DATABASE ACCESSION NUMBER: Contig37141
  ref <309>: DATABASE ENTRY DATE: 2001-06-18
aaggtttggtttcctttgaaatagaaattttggtaactcagctctacagccttcaatcaaagcaaagtactgacaatattgactgtactatcacctgggtcctcaggggacatcactagggtaggggtggaggtgcttttcaatccccagtgaaaggaggccaacttcagagagtgaacgaggaccccccagcatgccaagtcaacccatacgtggaacaacaacatgtacagagagctcaccccaggctcacaagacaaggacccaacagtacctctgcagggcacagaggtggagtgagtcacaacacccaaccctgcctgggtccctgtggacgtcggctttcattttctcacacagctgggaaggacactgcagcctgaggctataaggggagttcacagctgctgggcacactatttacagactcaggaatcccggagcagg

SEQ ID NO: 2210 - DNA, 792 bp, Homo sapiens
  ref <308>: DATABASE ACCESSION NUMBER: Contig37204
  ref <309>: DATABASE ENTRY DATE: 2001-06-18
attgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctaggctgctctggggcagccttcggtccactgctctgcatcgcgggc

SEQ ID NO: 2211 - DNA, 453 bp, Homo sapiens
  ref <308>: DATABASE ACCESSION NUMBER: Contig37281
  ref <309>: DATABASE ENTRY DATE: 2001-06-18
acaggtcttgggaaactttattataaaaatccaacggtatatataaactgcatttctctagcccaagatacttatgtgatactctacactgtagctcctatggcagaaataatatctgagaaacttcattttgaaaatttggacatattaagcattatagtacccgtcaaaatcttgatgttccccaaacttgagtcatctaggtgaggtcattgctgtcttcaaaaaattcagcaatctcctgtttactgttctagtgaacttaagtgaggttttcatttcaaatgctattatttctagaatttaccttaccctggtttattttcaaattcacctgttttttttcccttaatcgcttttgcccattttaaacagatggtttcactgttgctgactctttccctactgtttatatggcttacagtgttctggtgagatctcagtattctaaga

SEQ ID NO: 2212 - DNA, 370 bp, Homo sapiens
  ref <308>: DATABASE ACCESSION NUMBER: Contig37287
  ref <309>: DATABASE ENTRY DATE: 2001-06-18
ttatcagggtccaagcctctgcatgtgctggcttgtttggctttattttagaaaccaaccaacatgtttcattagcactgacacagcaggggtcccctgctgccacctgacaatccagcgtcacttacactgcacccacgcaggccacaccttcaatggccacggcacgctagcccagagttagccacacagaaacacacttctcaccgcacaaaactcccttttgaaaaaaccaagcaatcgtcaggtcggaggagaatcactagccccccacagcgagaggggacaaagcttggtggccgaggccaggtccttgtggcccctcccggtggggttgaaggtgcccgggactcctcggggttgcatggct

SEQ ID NO: 2213 - DNA, 422 bp, Homo sapiens
  ref <308>: DATABASE ACCESSION NUMBER: Contig37439
  ref <309>: DATABASE ENTRY DATE: 2001-06-18
cctgaaatagtgacagatattttcacccaaaccaaccaccaaaattaattaccatcttttaggtacacagggctatttaggccttttgacacataggaacgcatttgatattttttaacaattacacaagataaagcatgtaaataaattaatggaaaatgactattactattcacttcctacaatgctaccaactaccatatattgagtgtctctacccaattccaagcaccatatttgataatttcaatcttcacaaccctataaaacagacactctttttatccttgtttcacatatgaggaaattatagcttagagaggttaaataattctttgagttaaccagaccactggtggatctaggattcagacccaggcagtctgagaacagagctcctaattttagctactatttttttc

SEQ ID NO: 2214 - DNA, 357 bp, Homo sapiens
  ref <308>: DATABASE ACCESSION NUMBER: Contig37562
  ref <309>: DATABASE ENTRY DATE: 2001-06-18
acaagtctatctttatttgtaaaaaataatatacaactaaagctaatttgatttttaaaatcgaagttcatttagtgataatgtacactttataataaaattgtagtaaaatactgacatttgatagttataaacaaagtatcattcatgtaaaaatcatgttatagcatgtaaaatttaattagaaaattcatagctcacaaaagtacatatattttgttgatagctcgagaacattatcataaatttacttaagatacagaacaaaattcacagttaggcttgacatttagtactataaaattttatgttggatccactgatacttttgttaataaggtgcacttgaaataattg

SEQ ID NO: 2215 - DNA, 505 bp, Homo sapiens
  ref <308>: DATABASE ACCESSION NUMBER: Contig37571
  ref <309>: DATABASE ENTRY DATE: 2001-06-18
agttgtatttcttaggccatcccttttctacagagagaaccgcaagtcatcgtgagggtggaaagaatcgatagtactaaatgtcctttgcctaggctgcaagaggcacaatttcctttttcaatggatgaaagtaaaacggcaaactatttttgtttggactttgttgacttttgtgaggaaaccatatgacagctttaatatctaattttaaaattcagagcaggaaatgaggcaatcccgtacacaggccaagaaaaaaaccgtatcaaaatgtaaatatcaattccacattacagccagttaaagaacaatgggaagaccaagaaggagatggcagtgacagaagaaaggagaaggggaaataatgggcactaagaaagcagaaagagacatatttggagggagatggctaccgaaatctgggcttttcttagatcctctccaaggaaagttatcactggaaatacccaaggccctgattgtatgcactgtgctagggaga

SEQ ID NO: 2216 - DNA, 393 bp, Homo sapiens
  ref <308>: DATABASE ACCESSION NUMBER: Contig37598
  ref <309>: DATABASE ENTRY DATE: 2001-06-18
caccgcacctggccctggtagtgatatttaatccaatccaacaactataggctgggttaaataaaaggtcattattgtctatattccaagtggaattaaatgtagtcacagagattcctaacattttccttatatttaagggaaatcacttctaaaaaaacacactaatcagaactgtgatgctctaattagaaacaactcatctggccaactatttgctgctcagagtttctcatttcttagatgaaaaaaactcatcagttatattcatgtgatcgcggctaaaaagtcagtattttctttttgttctaatgtggcttcatttgaaatttctcagattctacattgtactaattatgaataacaaattataaattaaaaactcttaaagag

SEQ ID NO: 2217 - DNA, 481 bp, Homo sapiens
  ref <308>: DATABASE ACCESSION NUMBER: Contig37758
  ref <309>: DATABASE ENTRY DATE: 2001-06-18
ctctcacatatacacacacactctttctctctcacgttactttcactgtcactttctctctactggataacaggccaaaagtactggcactcatctttcactttcttccagctattcttcctacacatctctcactctcaggtaagttaaacatacaccacttccaaagccccagtctgccacagcacaaagaaaagccatgtctccacaggcagagcatgtacagctgagataagtcctctggggcctcacctttccctttcctctaaggaagagaatttcatctgccccatgagatcgagccctcaggggcttgggcactcacagatcaacatgttctaaggtagtgcaggggtcagcatcctaaaggcagcaccttggcaagatcccacatgtattttcttctcgaatccctaaaagtttccttgactgttgctccttactcacacacacacataaggcaggcacagaagggcagtgt

SEQ ID NO: 2218 - DNA, 576 bp, Homo sapiens
  ref <308>: DATABASE ACCESSION NUMBER: Contig37778
  ref <309>: DATABASE ENTRY DATE: 2001-06-18
ataaatccaaagaatttaataattagcttaatgcacagggtttttttgtaccttgcccattcgctgaacttttaaaccctcctacatatgaaagaggaacagtactctttagtattacatcactgaaattatagaattgctcagacttgagacttttgacagtttttcatgagaagtcagttacattaaatcaccctttgtttgcttttctggacctatttttgctcaatcccagataaaactcctaacccaggtttgggctcagcactgatttggaagctaaaacgttttgagataaatacaaaatagagtcccgtcccaaatgacacaggcctttttaatagcaacgaaggtaaaataaagcaggacagcacgtcctgaggatgaagtgttttgcagactcttctcatcgatctggtcaagaagggagaaaggctttggcctccctgatcttctgcctcacgcctctgcaggacaaagtgaggctagcgtggtggcgcttcagggattccaggcgccggtgaagcagttcggtcttgtccaccttttcttacaagtcccgaagaagtgagtcct

SEQ ID NO: 2219 - DNA, 422 bp, Homo sapiens
  ref <308>: DATABASE ACCESSION NUMBER: Contig37884
  ref <309>: DATABASE ENTRY DATE: 2001-06-18
gaacgtttttccatcattttcacaaatcagggatactcgtcccaattggcagggcccaccccaagactgccggcccctagagccctggccagggcccaggtctgggagctgccactgggaggcctgttgtgagtggtggtactggagctcagggtgcccccagttcctcttccggcccaggtggtcttcaccaggcctacagcagggggttgagggcaagcacccccttcctgaggatgaggtttccgtagagggccgtctcccccgttgccacaacagcaaaagccttcttagcccgttcataaaactcaaacctctctatctttgccagggctctcacacagccggccctgcgtaggatggactcgtactccgtccacactggggtctgcaggcccctctccttgtcgctgggcaccagc

SEQ ID NO: 2220 - DNA, 437 bp, Homo sapiens
  ref <308>: DATABASE ACCESSION NUMBER: Contig37946
  ref <309>: DATABASE ENTRY DATE: 2001-06-18
gatcttttaaaattttattttataggtagcttcgataaaagcttcagatagacccacatactatacagagtttgtgaaatctacactttcaaatcataatattctctattttaggctattatatttagaagcatgacatctcaaatccttttattacaagtagttcttgcacataaatgttatatcacaatagcaaaaaaatgtaaacttcttttgcaaactacataaatactataatatctaccttgaagttattctcattttaaatcagaatacactctaaatgttttacatagaaaactctcgttggtagcctgtgtgtatgaaacatcattttttctttcttaactacttgtctttcatgttgcctacttaggtctctgaaggagaaaaattcaaaatagaacccagatcaaaattcagttcacatgtaagcc

SEQ ID NO: 2221 - DNA, 334 bp, Homo sapiens
  ref <308>: DATABASE ACCESSION NUMBER: Contig38170
  ref <309>: DATABASE ENTRY DATE: 2001-06-18
actcttgtgaataggatcaatcttttttccaccactgcattcttcaactggttatcactggggcatagaaaaacaattatcttagtatgttgattttgtttgaacaactttcaaattgttgaactcttattaggtctaacaatctgttgtacattctctggtttctttatacagacaattgaatcagtctcgttgctttctttccagttcttatgcctcatttctgaattactgagcatgggtctgccccagaatgttcccaccattaatggtaaggctgctaaatattcacccttaactatgtttgccaaaggtttgataaatagccctttac

SEQ ID NO: 2222 - DNA, 434 bp, Homo sapiens
  ref <308>: DATABASE ACCESSION NUMBER: Contig38285
  ref <309>: DATABASE ENTRY DATE: 2001-06-18
aattttaattcaaatttttatttaatcaaaagtcaaaatgtgaatacttgattagtggaattattgaattggtaaaacatacaatcaaaagtgaattcttagaactattattatgtcttaatccaatcccactgagctatatcttgatttcatatttttatcatgtctatagcttgtatcttaattgatataactcaaaagtaccatatagacatctcaaactaaagatcaccaggtgcttagtttcagagctgggttgtctgctatggaaaatatttcccagaatttagatgagattgggaaagatattgcccagaagagttcctccaaaatgccctttatatagagctcaggagaatctggaataatactgggctagatactgccctaaggccttgtacacttaaactaccacgatgtgcctttctgaatat

SEQ ID NO: 2223 - DNA, 418 bp, Homo sapiens
  ref <308>: DATABASE ACCESSION NUMBER: Contig38288
  ref <309>: DATABASE ENTRY DATE: 2001-06-18
aatgttcccagaaatagtgtatttgtttgtttacatcttcagaggcaacggaccactaaatgttttgggtttaaaaacaatgtttaaaattatcaaatggtaaaagacatcatgaccaaagcttgggagatcagtgcctgtgtggagacccttcccaaaacagcttcaggcaaaggaagcctggccccctccgtgggccgagtgagatgcttgtgtgtgcagcaggtgcctctgtggtgctgggtgaagagcagacgacagggggggctttagaagtctccctggggcctacgctcccaagggcagactgctctcctccccatcccccaacagaggggcctgtgctctaagcactgcccgctgagcccagagctgccctccaggcacccgccgtcccaacggcccccatttacttgtc

SEQ ID NO: 2224 - DNA, 434 bp, Homo sapiens
  ref <308>: DATABASE ACCESSION NUMBER: Contig38398
  ref <309>: DATABASE ENTRY DATE: 2001-06-18
actaccagcgtgaacaaccagcatttttattgcatttgagaatgcttataatgtcagtaattagtactgactacacaacatttttttattgtctgtatccgcagacatggaatgatggaattacagttgatgtcaaggaatgagtttcttttatgccttatcaaaacaaaacaaaacaaaacaaaaaaattcttgttactggcagcacatatacatgaagcaccatgctcacagtccggactgtatcatcttcatcaaggcttatgggtagcagagattgcgtgagctacactgggcccaagaaatgccttcagcattgtaaatctgattttcaggataaagaagcaaaactgactttgaagacatccagaatttcaggaggctatgtcattaaccaaaaggtaccaaaaagattcaaaatctgaataagcaca

SEQ ID NO: 2225 - DNA, 568 bp, Homo sapiens
  ref <308>: DATABASE ACCESSION NUMBER: Contig38520
  ref <309>: DATABASE ENTRY DATE: 2001-06-18
aaggaataaggtgaatttttattaagtgaaaaaaatcaataacaatataggaatgatcacatctatacaaatacattgctacatttctacatataaaatgtataggaaaaagtctgaaagaatgcacaccaaattattctgtttttaggaaaagcagtaggattggtcagggcatggaatgtcggctaagtgaagtgagatttaaaatttttattctacatgattttctagtgttgggaatttttgacagtgagcatacatgcacttattacttgcataattctgaaaactattttaaaaacaacagaaaatatatgaaagtctattggtgtatacagcattaatagtagtgaaagtttaacagaaaagatctgaaaatctcccaaagttatatagaaacagatctagctgacacactgtgtacctagaaatgattttggatctcttcacagagacccctatcccaccaacctccaatcctcccaccatacattgatccctttctatctgcttggatcattagctgtaaatttaacttcgaaaaacaaagtacgtttaatcattgtac

SEQ ID NO: 2226 - DNA, 358 bp, Homo sapiens
  ref <308>: DATABASE ACCESSION NUMBER: Contig38580
  ref <309>: DATABASE ENTRY DATE: 2001-06-18
gcttcacaaatgtcaattttattgacactagtgcacaactaaatacaataattgcaaaggaagtggaacgtgtcaaacagaaatggtgacaatgagttagaactgcagttgtttcaaggtactacactattatttaaaaaaaaaaatcacaaaaagaaaaatgttatcactacaagtaggaattagaagagagaaattctggcagtctgtctagaggttaaaacatttcatgcatttgtgagttgctgttggagagttgttttttatttgtccaccgtaatctggcaacatccggggcttaccttcagctctcgcactgtgcgtgagatcgggtgaggcagttataagtgagagcatg

SEQ ID NO: 2227 - DNA, 451 bp, Homo sapiens
  ref <308>: DATABASE ACCESSION NUMBER: Contig38630
  ref <309>: DATABASE ENTRY DATE: 2001-06-18
ggtttcagttccctttatttttatatggcttacatgtaaatcttttttaaaattcgacttaaaatccaatacaaatgttcttcagtcattagtaaatttcaaagcgaagtcagtaaaagacagaagctggcaactgccttttcatccttcacaagtacaggactatgtcaggggtctgtggccttcatcagcaggtgccctcctttggcgagcggatctgattctgtgtggagaggaggaagtgtcttcttcagtttcagaccctgaaggctcatgatctccctcttgggatcctgtgtctcccaccagttcccggagaaacttgaattttgataaaaaaagatgccatacaaaataccaaccgcacaccatcagcagcaggacgatcagcagcgtggccacgaacacaagcagagtcagcccgacgctgtgccacatcttgggggcagaa

SEQ ID NO: 2228 - DNA, 436 bp, Homo sapiens
  ref <308>: DATABASE ACCESSION NUMBER: Contig38652
  ref <309>: DATABASE ENTRY DATE: 2001-06-18
aagttttgtctgtttatttaaaaacagaatatcattttatgtacaaatatgcacatatttacataaaatgtacatgttaggatcttagatcttcaggctccacattcgaagtcctaggctggctggggaacgaaggatgggagcctctcccttaggccagaaatccagcagatttcagactaagaagagtttgggtactaaatctaggtattctggctgagtgtatctgggtgggccagctaaaaataaacctcattgaactccagccccaacccagagaaacatccagaagagccttgaattagtgatccaaaacccagggggaaaggcgacattctcacccccagcacctccttcacctcacctcaactcctactctctcggtctataatcactgctctctctctccccaacaccactattgaacaggagccct

SEQ ID NO: 2229 - DNA, 547 bp, Homo sapiens
  ref <308>: DATABASE ACCESSION NUMBER: Contig38683
  ref <309>: DATABASE ENTRY DATE: 2001-06-18
accttcttaactatgagattattacaaatatatttttacaaatacaaaaaactgaagtacagagaggctaagttaatttctccaaggtcccacagcaagtaactgcagaagggcaaagcaaaaataggacaacacatgtaggcaataccaagcagttcttgtggcagcaactggaaaccttttggagacaccattctgcatttcgttgtagtcatacacaaaaccctagttatgtatccatgcttctttctcataatgccaaagtggcactattctaatttactaacaaggttttctaaaaactacccaaattattgaggtgtttttgctcacttcttcccattagaataaatgtagacaataagaaacgcatgagggatgacatagtcctccatcaaatctgtcctttcacacaagagatggcatggtgtagtgtagcagaatcatgagctgccaggaaattatgaattctgattcctccagctgagtctttgaaaaagtccagatgagaaacacttccatcctgatgctgaagcaaggagaatgt

SEQ ID NO: 2230 - DNA, 441 bp, Homo sapiens
  ref <308>: DATABASE ACCESSION NUMBER: Contig38726
  ref <309>: DATABASE ENTRY DATE: 2001-06-18
aatcaaaatgcttttattatggtcaaaatcagagccattgagtcctaacagcttaaactagatatagaaagcagggcaagtagtgtaaaacctccacattttctaggcccttcttcatatagcagtttgattatacttcaatttggtgttaagaggacaataatacaaagtaaatgtccacaaaggaccaaaacaccaaattttccatgtccaacaactctctataattaatctactatgtagctagtgtccacgccaaatgttcagttcttaacattcgccaagaaggaatgggaagaaacagatgagtgacttcagatagggagtacactttctcttcctagtctccatcgaacaatctcacttttttaacagagaatcccccacagctacatccaagttaagagcaaaatgcttacacaaaaccaaaagacaaattac

SEQ ID NO: 2231 - DNA, 581 bp, Homo sapiens
  ref <308>: DATABASE ACCESSION NUMBER: Contig38791
  ref <309>: DATABASE ENTRY DATE: 2001-06-18
cacacatagaatctatttaatgaggctttcccatgtgaacaaattcccttccataataacagtttctctatttcctggctgtgcttggcactacagtcccattcagtccggtaaaacagtggtacgtcttaaatggattttttttttaattctggaaatgaaacacctagtacctgcccttcctcttgtcttttatagtggtttctcccttttgaaataccaaagaacttgtcagtagggaagtaggcagggtgggccagtctgcaagaggcctgtggctgtccctattagcaccagcaggtggcgccactgaggaccgctccgaagcgctctgctcctgggtgctttctctgcggaccagtcctagaactgagggtcccacactgcccgcatcaaccatgtagaggcaccaggacggtcgcgtgtcattaggaagaagtgctgtgtcatccttcacagtacactggggagggttctcctcctgaggcatctggcacagtgcacggctggactcccagcacactgtgaagaggaggaaatgatgcatgtgggggtctccttccaagcccttcgtctctggt

SEQ ID NO: 2232 - DNA, 413 bp, Homo sapiens
  ref <308>: DATABASE ACCESSION NUMBER: Contig38901
  ref <309>: DATABASE ENTRY DATE: 2001-06-18
aggatcttaaaaaaccatttaataaaaaaaaatctttgaagggacaaatgggaagttttcacttagagtttgatttacaagacaataggaggaatcagatttgggaacacaacaggcttgaacactttctggagactgagagacagttcagagtcagccctcaccgttagccagacccctggccaggacccgcagcaggctggtccagcgggtctgtggggcactcctgtggggcactcttggtggaaacgatgagccaggtgatggtctccccaggagtgggcaatgggtgaggcctgagccctgaactggctggcttttggacagtccttgaaaatgtggctgctccagaagccactcaagctggaccatggtcacagttaacctcaggcccaacattaaacaaaaatgta

SEQ ID NO: 2233 - DNA, 427 bp, Homo sapiens
  ref <308>: DATABASE ACCESSION NUMBER: Contig38983
  ref <309>: DATABASE ENTRY DATE: 2001-06-18
gagatttcagacagttttattaggagattgttgaaaaggaaaagaaaattaaatacaataacagtaaacgtggttctcacattgaaaccaggctcaaataactaggctaccatagaaaaatttccaattcttgcattatgatgtaaaaacagatttttgtacagattttgtacaacaaaattcgtaataaccttttatcatttttagaaaactttaaatatatagataaaaatagacaattttcataggtcctacatgaagatgagtatgttctgttccaagggcttgcatagagcgcaaatgtggttataatatagaacaactagacattaatatttttaggattacaaaagcatggaaaccataaaatgggcacattttacttgtttatgccaaaacacaaatttccaaaccaacctgtataact

SEQ ID NO: 2234 - DNA, 630 bp, Homo sapiens
  ref <308>: DATABASE ACCESSION NUMBER: Contig39090
  ref <309>: DATABASE ENTRY DATE: 2001-06-18
gaagacacatgatgtaatattttaatgtaatatttaaaaaaaatcaaattggtatctctggtccacgtcccagctgcctattttgtaaatacagttttattaaaactggggctgggattagggttagacaagccaggtggggtcatccaagtacagggccagacttgtttttattaaaaagtttgatattttatcatggatttcttttctttaccttttctttcttttctttttttttcatgaaccttatttgttcaactattttatttttatttttattttattattttttttttagctcttttgatttgggccaaatctttcctcacctattgactaatctctggcatctcactggatctcaaacctccacctgcctattaaagtccccaccacaggtcctaatttaagctcttgccagacagttccaccttgctgtgaatgcagaaatgagatcaagtcccactcagaagaaaccagaagatgtgaggtaaccagaggggcggctcagcctccagggcagaggagccataatctacctggggccttaccattttccagaaggtccaaagatccctctctgtggcttccttggtagttttcaagggcaaaccttaggcgccatctgct

SEQ ID NO: 2235 - DNA, 543 bp, Homo sapiens
  ref <308>: DATABASE ACCESSION NUMBER: Contig39132
  ref <309>: DATABASE ENTRY DATE: 2001-06-18
ctctatagcaatactttaatattccaaagaaaaatatgaactgagaattgtattatctagccaaattgtttttactgtgtaaaggctacagataaacatatttgacatggcaaaaatttagggaaattgttccatgagtcttttttaaggaaactattaaatcattaatttcagctgaccaagagattaatgggaatgttttgagtttcaaatacatttaaactgtggaactaagaaatgtgaggatgacaacagaatgtaaatattatatgtcctcacaaggtaggaatgatacaacaaaaattgagagaaaaggaaaagaaagtggaagttcactgatacaataatagttgggcaccagagtgtatcagctaaagctaagctgacaagtcaaagagaagtataatcacatttaacatacaaaagtaggtcaggtgtggtggattatgcttgtaatcccagcactttgggaggctgaggcagatagatctcttgaagccaggagttcaagatcatccaacatggtgaaacctcgcctttact

SEQ ID NO: 2236 - DNA, 484 bp, Homo sapiens
  ref <308>: DATABASE ACCESSION NUMBER: Contig39157
  ref <309>: DATABASE ENTRY DATE: 2001-06-18
ttaaatgaccccatttgtggggtggtttattgttaaaatgattaaacatgctaaaatcacatggagtggctattccacttttgccctgactccatagtggggcaaatgggaactacaggagtcacttggtttgtgtggcctctggggatggttagacttggagggttagcggtgaacaggttagcaaagccccaagcatccttcatgtagtacacttttcccagcagtaaaaaaattcagagatttcccccttcttcacttttctttcctccctatatgtgccctacttctcattctcctatggccctggaacctcttatgcttctgcccgttatggtcttagactagatgatgagggaggcttttccttgacaccagcattccagtctcccttccttggaactaatctactcagcatgcactattgtggtaagctgcttgatttaggtctgcctagggggaaaacgaggctccagtccccact

SEQ ID NO: 2237 - DNA, 510 bp, Homo sapiens
  ref <308>: DATABASE ACCESSION NUMBER: Contig39226
  ref <309>: DATABASE ENTRY DATE: 2001-06-18
cctaaaaaaggcttatatttacttgatttgaattttgctagcatgctttttcttctgaattcaagtgactagaactgaaattattccacctggggagaagagacagctgaaagccaatttagtattggttttcaaatacatgaagggtactcagagagaggatgattgccaaagaaaatggtctttgaaccatagaaagaatctgagcttgctctaaagttaaatttcctgacttacagagtttatgacattaaactgagagaccaagggatcctttttggagacttcaaaaataggatagatccttaaatgcctgagatggcttggatgtggctttgtctgaagtcaggaggataaatcttaccactgatggtcccttcaggcgtgtgaatctatgggtttgactggcatgtcagaagctagaatgccagcccaggacatctagagagtcatctctccaatgctgggtagcagtctatcaatcgctctcactgcctcaacatctctcag

SEQ ID NO: 2238 - DNA, 724 bp, Homo sapiens
  ref <308>: DATABASE ACCESSION NUMBER: Contig39285
  ref <309>: DATABASE ENTRY DATE: 2001-06-18
aaagtgaattgaggtttttaatctttttctgtggcttggaagattgtaattaactttcaaattatctgatctctaaaggttggtgagagctcagctgtgatctggagccatctagagctttcttaatggtagctttttaatcacctctctaatctgtttttttttttggcaattagttaattcaagttttctactttggctcagctttagtattttgctaggaacctatctgttccatccatattttcttggcttttcctggcctgcctggcacagtctgtactgagaggacgaaggccttttccatgagtgtccttggccatgagtgggtcagggcatctccttgttggcttgggtatcagtggggagtggaatgaggacacagcttcacctctaaggactcagaagccttcttgcaaagacaaggccacccctcccttgggggggtttggggggttccaagatgtgaataaacatggagtgttcacaccatcccacggcctgcaaccccagtgagaaggccccagccgcgtttctctttggagtggcccatccatagcattctgcctaaaaaagcagggtcctggagttccagggcttctcactgcacagggcgtgggacacacctcttgtctcttgggaggtacccggagcccagcctctcaggcgctgggcgatgcagggggtggggactgtaagccctgggagatggggcagtgagggg

SEQ ID NO: 2239 - DNA, 466 bp, Homo sapiens
  ref <308>: DATABASE ACCESSION NUMBER: Contig39556
  ref <309>: DATABASE ENTRY DATE: 2001-06-18
ctttcaatggggtaactttttcatcttctaacctgctctttaatgttttatgacaagcaactgtttcactatcatcagggagtggtatggttttaaatgaggctttctcttccaaatattctaatttatcttgcatttgttcactttcttcctgatcgattgaagaaataaaggccggagcatgaatattcaatatctcacagccttcagaaatgatactaaaggcagtcttctgatcttctgaaagtccggctggcttactagtcactgtaaagtcttcaccttttgcatatgtgtcttcaggttccttgggcatttctttattagaaaccattttatcagcattgcttgctgatgtattagatataaattgagcatagttgctttttgctgaagacagtggttcctttacacgggtatcttccgcagcctccaagtggtgctttgaaacaagaacagattgttt

SEQ ID NO: 2240 - DNA, 488 bp, Homo sapiens
  ref <308>: DATABASE ACCESSION NUMBER: Contig39591
  ref <309>: DATABASE ENTRY DATE: 2001-06-18
gcaaaataatggaagatccttttgaaacttagtatcttcagttatcaatattactgcattatggagctagtgcaatcctgcatagccttggtcaaaatgacaaggcaaaaaaaaaaaaaattaaagtattatatgaacaagagaagtcattgaagataatttaaggccttgaagtgaattaatcagtctaatttaaagctgaagaataaaccataaattatccacctgaaatgcaagcaatatgctttttcagcttctgttctgtggacaaaataacagaaacaactcttgcttatggtttgtgtattagaatccttctggacctggaggagtgaaagtcaattccatttttcaactgttcatggaagatttcaggactgttttagccgtttgcgtggaatgccaaactgtggacactgtgcagatgctagtgctcgaaaggcttctgctactaaatgagggtgagactgaatcatggacttccaccc

SEQ ID NO: 2241 - DNA, 596 bp, Homo sapiens
  ref <308>: DATABASE ACCESSION NUMBER: Contig39826
  ref <309>: DATABASE ENTRY DATE: 2001-06-18
gcagaatgtgtcaacaaaaaatactttcttaatggcatttgtgttttaagaaaaatcagtcacatagtgtcagtgttaagaaaaggttgtaggtttacaggttgcccccagtggccatactttgaattgtgattctcacgggtttaaagatgtgatttttaaaaaatcagtgttttaccatctagttatttgatcttgtccacttttttgtgttcaacaaaagtgtaaaactggaaagcaaagaaaaaaagactattttcagtaaacatgtagttttgttttgtctttattgatagaatgtaatgggcctttgggatcttaagtactacttatgttacctttgttattcagatgctgaacttaagcagtgaaataatagaaactaaaggatgttattaaggggtttaactattttaagtcaacatttagcttatccatcatattggtttcctgaagatgtcagaatttttcagtgtaagacaaatatcaaaggtaatagatccagtttaaaaggtgaatccactgtatgtattatattgataccatcattttcaggatctacattaagaggatggtgatacataattagtaatctc

SEQ ID NO: 2242 - DNA, 437 bp, Homo sapiens
  ref <308>: DATABASE ACCESSION NUMBER: Contig39845
  ref <309>: DATABASE ENTRY DATE: 2001-06-18
ctgcaagcaaaatttattactataccatttatttgatgaattaatcaatgttcaaatggaagaggttttgacaatgtcactatgtttgatgtttatacctgccctgaatgcttgctcagaagagaaacagatttcccagtattttttataacttactttcccattgtcttcaattaatttgctattatcccaagtagacagacaacttcagtagtagccatctccctacatttttagatcactgaaaaaaatggatgagcaacccatgaaaataactagcttactgaaatgcttgtcttttaaagaaagttgggattatttaaaaaaaaaaaaaatggcccaggaccagtagctaggagatctgggagagagaagtcattgccttggttctgacactaagtaacccttttgccttttgcaggtaacttctcatctag

SEQ ID NO: 2243 - DNA, 507 bp, Homo sapiens
  ref <308>: DATABASE ACCESSION NUMBER: Contig39891
  ref <309>: DATABASE ENTRY DATE: 2001-06-18
aagtcagttgttttattaaaaaataagcactatgcttgggtttcataaaatttatacatgaatatgtacacagacacaaataaaataatattaaaaataaaaatcacacttgctttcaaggcagtggtcctggcaccccacatacataatcaacttttcctttaaagaaattgcttggcccaaggagaccacagttagagaaccactaataaagctgtagcccgttgcctgcaacattttcaattcgggtttcaaaaatatataaataatttaattacaaaacccaacattttttttctcttttggcacagtgaagcatcggtcaatagcaagaaatcactgaagagcctctgacatgtctctcacactcagtcatacctggaaatgccacatacgtacacggatgggggcccagaaaccccaaacagtagtcatatcatttatagtgtggaaaggttccctgatgtacttaggggggagggaagggacataaatcaatggaagtgc

SEQ ID NO: 2244 - DNA, 391 bp, Homo sapiens
  ref <308>: DATABASE ACCESSION NUMBER: Contig39922
  ref <309>: DATABASE ENTRY DATE: 2001-06-18
gatgttttaaaactttaattatgaaaaagggataaacaattcaagatgggggaaccagccccaaactggctggggcagagagagaccagtccccagccatacaatagcagcaaggggaagaccccaccccacagatgctctgccccagcccttcccagagaccttaaataatttaaatagcagggatggcggagggcaggttgccctggtgtctgcccaatgctaagatgaggggcagcgccggcccagcctcagcctcgggcagggctctggggctgctgcagggctgggaggtatttgagggcagcagccccatggtggcgggacaagtcctggtggaattcgtccttgagggcctggaggcagtcacgataggtggggctggagcgga

SEQ ID NO: 2245 - DNA, 366 bp, Homo sapiens
  ref <308>: DATABASE ACCESSION NUMBER: Contig39960
  ref <309>: DATABASE ENTRY DATE: 2001-06-18
acagaatacattcatttattgggtcttatcttaaatctccttattagatattcaattcattgtcatccaaaataaaaaaacaaacaacaaaatgcttatgacagaaatcacaaacagatggctaaaatttgaaattgacctcatctctgttctttaggataaatgatacagtagttttttcctctctagcctaaactggcttctgggttttctgataattcactgtactagtacaacatcatggcaatttgtatttccaggattttcattgtcttggttatcatttccaccttcttcgttattctcaggagatacactctcctttttttctgtgggagtagtaactgttttctcaggttgagaatt

SEQ ID NO: 2246 - DNA, 397 bp, Homo sapiens
  ref <308>: DATABASE ACCESSION NUMBER: Contig40026
  ref <309>: DATABASE ENTRY DATE: 2001-06-18
ggtgtctaatacttttacttcccagcagcataataccactttggtcaggttgaaccactgcacaattttgcagctctttcagaaaaataatgaaaacaattggaaagacatgatgtacatgcaaatggtgagaaaatgatactattgtccaatcctttcccgtaaatgtaaaatatccttagttcatctccaaactgtgtatttattataagcccttacatcagggattttgtttctttcagtttttgtagcaccaaatagacacagcggctaacaagaaataaatctgaaaagtcactgaaatatttatcacatgtcagaaattttctggtctgtacctttaaccatgttcctggcttcacatattcttcttaagagtaagctataacataagatt

SEQ ID NO: 2247 - DNA, 464 bp, Homo sapiens
  ref <308>: DATABASE ACCESSION NUMBER: Contig40121
  ref <309>: DATABASE ENTRY DATE: 2001-06-18
caagttgacatgtgtatttattgcacaaatatcccctagaactgggaggttattataatacaagtgtacatttgagaaatgtatacagaacaagaaacagctatgtacatatccaacatctaagtaacttagaaaaagcagaacaatctcataagacatctaccagaagtaggcattatgtaaaatctgtttttttaagtgatcatccccagagtatgccaattggaacaaaacaaaatctgtactagtatgtttttattgcacttaacattttcaaactcaaaattaagacatattaataaaagccagaaatatttaaaatcaaaccaattagtttatatacaagaaaaaattagttttaattctataatgtaaaagatcccttttttatttcctgtttcaataaacaggttttttttgatatgtaacaactgtctgtaccataacttgtaaaaattatttag

SEQ ID NO: 2248 - DNA, 516 bp, Homo sapiens
  ref <308>: DATABASE ACCESSION NUMBER: Contig40128
  ref <309>: DATABASE ENTRY DATE: 2001-06-18
ctgaaaccatcaccataaagatccttccgaagtaaagaaatttggcattatggcctgattaaaatcccattaaatgtacacaggacaaggtctaattatttaaaaggaagccctcccttacctagttccctgtccacctctttatcctcatcattttccacattcttcagccacactgcagttactcaaaagcaccatagtatttcctttctggcttgcttactctactccttctgcctggggtaccattcccaatatgtggcttggtaaatttataagagaaacttttaaagatttaattcaaacatcattttgtttctgtttttttttttttttcctctggcttccaaaactggtcctctctggtagaactgatcactctagttatttggctatattaatcttccttcacaatgcttaaagattcttgggggcaggaaactgtcacacattcatctttgtcttctcagtagtgatgtgcgtaagtttgactttgacatatttgccccaaatctg

SEQ ID NO: 2249 - DNA, 395 bp, Homo sapiens
  ref <308>: DATABASE ACCESSION NUMBER: Contig40146
  ref <309>: DATABASE ENTRY DATE: 2001-06-18
tgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgc

SEQ ID NO: 2250 - DNA, 478 bp, Homo sapiens
  ref <308>: DATABASE ACCESSION NUMBER: Contig40208
  ref <309>: DATABASE ENTRY DATE: 2001-06-18
ctttttggaggaagtttattaaattaaaaaaaaaaaactacaaatgagtaattataaaatataatttcactcttttcattatttaccacaaaaatttaaaaataccaatatacagacgagcacaagtgaactggaaaagagctaaaaattgtataaaagacaaatctaaactcaagaatatatgagaagtgacatacaccatacactctcaagtgagttcagaaagcatgttccgtgctgggcaggttttctttccaggtcagtttttattggcactacacctggaaagctctctaagccaaagttcttatgtgtcaggatcttcctagacctcccttggaaagcatttctcataaaacaactcacaccagacaggctgacttattgtaggcacaaaaatcataaatgcctctcataggccccatggagcttggaaaaaaaagatctgctaatgaaagcattacaaaaacagaaaagt

SEQ ID NO: 2251 - DNA, 656 bp, Homo sapiens
  ref <308>: DATABASE ACCESSION NUMBER: Contig40212
  ref <309>: DATABASE ENTRY DATE: 2001-06-18
cctcaactaaactctttatttttggtttggtttttaagtaggccatggttgctttgaggccactgtatggtggcaaactatagatgaaagagcttttattaaaaaaggcactgatgggagacactggctgcccccgaacctttgccctccctaagagcagcctctcagttcccttttgaggagccccctcacctccaccagatatgggaagacaaatggggtccctgtttctggattcccagcatggtcgggggaagatctgtgacctgggcttggccacgggggctctcagaaggcaaggcctggttggagggtgttggtgggggcagaaagctgagcagattctgggagcagcccaccccatatcctagtaactcccttttgctcttccagacttattatgcggcttggaccattgatgcctgtgctcccaggagatacagcatcaaatggcgtggagaaaggacctgtcttaggatgtgttcccatgttgcttcaccttcttagggagccgccgcagtgacgtgcgcctggcctctcccttgatcagacccgaggctcctgggtagacctcctcttctcacttgcagttaaggaagccgaggccccatgggattaggtgtacgtccaagatctccaagtactagaggagtctg

SEQ ID NO: 2252 - DNA, 442 bp, Homo sapiens
  ref <308>: DATABASE ACCESSION NUMBER: Contig40238
  ref <309>: DATABASE ENTRY DATE: 2001-06-18
gagtactaaagtcctttattcaacaacacagaaatttcacaaaaacaactttactgggcaaattgaatgtgattttttttactttttttttttttttacagttttgtacatgccccataagtaattttctttaataaatacactgttttccaaaaccgttttttaaataattgcacaagcatacatacaccttacacaaatatctattagaaaatttaatagataactgcacagttcagaagaggagaacactgtgaaaggagtacattttgtggcccatgttcctgaaatatctgttttgcaattgtgaaaatggaatccctcctaatatagtagctgtcttttattcactaggaatacagatctcagtgtgaaatgccaaatttaataaaaaaaaaaaaactgaaacatttagctgttacatgagaaccaactgtttgat

SEQ ID NO: 2253 - DNA, 434 bp, Homo sapiens
  ref <308>: DATABASE ACCESSION NUMBER: Contig40434
  ref <309>: DATABASE ENTRY DATE: 2001-06-18
ggatttcataaaatgattttaatagaaaagtacaagatatgaacaaaaataaataatctttatctcatttctagcccagcaaattgtacactgcatataaaaatggtctaagatgcaattttcctccattccttttttgcttttaaaatactgagacagcattttaattcaatattctaggttcaaactgatacattaaaaaaaaatcataccaacctttaatcattctacatccattttttaaagttagctaacaagatgatgtttcactaaaataaaatatccaatcatcagattaaagtgtaaagtttgtgtgaacagggaaattagatcatttctctaagttttaattcctatgtttctgaatgtttcttgaattaaaaattcatttcatcatcttactttcaaaacacggcatctctctttcaccattc

SEQ ID NO: 2254 - DNA, 441 bp, Homo sapiens
  ref <308>: DATABASE ACCESSION NUMBER: Contig40446
  ref <309>: DATABASE ENTRY DATE: 2001-06-18
agtagatatccgaccaaacgttttattggggttttattgcaatctactttcagcaataaggggaaagtgagcatgaaaagaactccaatcagactttattcaataaagcagcttttcatgaatgcttcaggtcagtgtatgatcagctcagcttccagtatcaacttgagtacctcattatggatatttatgctagaatgacaacagtaaggcattgcaaaatccaaagtcatctaatattaaaccatattttacataatttgtaggacagtatactaatactctacaataaataaggatttaaaaatgtgttgcttagcccttgaactaaattcaattactagcttattctaagtactccagttaataaacgtttgattgtaaagaactctgacttctccaaagataaaaaaaattagttgtcatgacaaaaattaagct

SEQ ID NO: 2255 - DNA, 383 bp, Homo sapiens
  ref <308>: DATABASE ACCESSION NUMBER: Contig40500
  ref <309>: DATABASE ENTRY DATE: 2001-06-18
cccattgtatttgctttcttctggttttcatcagccttttaagggcacagatattttaatttaaagggtgatttggatatgcttttttgttaactgagattcatgccacagtcagatactggtgatagaaaagcccaaaaaggcttgtagaaaagaggcaagcagcaatccaccaggtcagaaaagacagaagtcctcgaaaaagaagaggagtaaaaatattttttaagctgctcagtgccactgttatttgtgtaacagttaccttcattttcccttcagctgatggtaattcagagtaaacagaattggacagtagactattatccactggtaaggtagagatagattctggataaataccccaggaatgattacctaga

SEQ ID NO: 2256 - DNA, 481 bp, Homo sapiens
  ref <308>: DATABASE ACCESSION NUMBER: Contig40573
  ref <309>: DATABASE ENTRY DATE: 2001-06-18
caaatccatttggaacacatttattcttgggatagtttggacaatcacaaggcaattctaaggaagactcccacgacactgcctaagaccaagatttgggaaaattgattccactgatcactgaaaaatttcttgcccagtaactgtcggtggactttatccaagaactgggggttcaattagtaggccaaactccacacctcttacagtaagatacataaaagataaattaggtcccctaggcgcaaggtcaggtgacacttcggtgactgcagaaggggcgattcctagagatatgcttcaaagcaagtgggacttagagataagcagagccgagaggtggatacggctgctcgagagggatctacccacaagataagccacctcccgccagcccccaaggtttgctattcgacaccgttacccagcagctccgccacacacaggcggacgggagctggatacctaagcaaaaaacgct

SEQ ID NO: 2257 - DNA, 503 bp, Homo sapiens
  ref <308>: DATABASE ACCESSION NUMBER: Contig40712
  ref <309>: DATABASE ENTRY DATE: 2001-06-18
attgtagactagtctgtttttatttacaatttaagatataaattagtaaagaattcgtgttaaacaaccaacaaagattgtataaccagcaatgttcaaataaaaaccaggcagaatttatttacaaaaagtttagattccattgcaatacaacttgcataaattactagaagctttatatcattataaaaataaatatcaaatttgtttccacttctgaagtactcaagttcttccatcacgttttatttctactgtgtacatcttttacaaataaactttacagtaaatcctatcacacctatagaatatataccgtggcaatgaagtgatcaattcaagatatcctgagaaaaacagattgttttcaaaagtcacacatacatcggggaaactatactatgccaacaaattcacatatgtccaacaatagtctgttccaattgttagagtctgtgggctgacagtgctgtgtggatccttctcttttacagtggcacaag

SEQ ID NO: 2258 - DNA, 379 bp, Homo sapiens
  ref <308>: DATABASE ACCESSION NUMBER: Contig40813
  ref <309>: DATABASE ENTRY DATE: 2001-06-18
taaattttacacatttttatttttaataataggagtaaataccttcccacaacaatataatgaacattacaggaaaattaaggcaacttattatttacagaatgcctttctgtgcaaaacaggacactatactcttcctacacattaaagcattaaagattaaaataactctaaaaggtacttattatcagtgtctttactgaggcaattaccagtgttcagataaataaatgtcagagctaatccaaatatgaaacttgaaattttcccaccattctatacaaattcccacagcaaacagaggaggttattattttagataagtcagggaaagactttgcagaggaagtaacatttctgagatggagaaaactaggag

SEQ ID NO: 2259 - DNA, 698 bp, Homo sapiens
  ref <308>: DATABASE ACCESSION NUMBER: Contig40816
  ref <309>: DATABASE ENTRY DATE: 2001-06-18
gagtgaaatattttattgaaaatagttaatttaaaatatatacatcatttttcaaaagccatgtgactgataaaaatatcaaactttccatacaagcatcatctcagcttcatcccctcggcaaagtgtctcccgaatctttccagatggacatttcgtttgagtctctagcgccctctggtgaaacaccatgaaattgcccaaaaacgtaattcaggctctgctcaggacggaaggtgaaatagcagaatgagcgcctatttcaatgtgacaggttgtgatgtgctgccttctccccgagctcaggagaaaggcagcctctgtgagtgcttctctctctttagggaaagtattcttcccatggacactcagccaagcttattgcaaaataccttcttcctaagttttcatcatcactgccttctgaaaaaacaaaaaccggtcaatacagacaggataaataatgaaagcctccaagtcattcaggaccaggcccctactcctcgcaaatgttagaaggacagcaaaaatgataaagcaagctgagtatgcaagaaaagctttcctagtggtccccgattcttcaagctgtctttacaataatgaataccaccactctagtcaactcaggtttacattttctggcagcagatgaccttgtcctcaggtttcaagaagcacacctcttctaaatgggg

SEQ ID NO: 2260 - DNA, 556 bp, Homo sapiens
  ref <308>: DATABASE ACCESSION NUMBER: Contig40831
  ref <309>: DATABASE ENTRY DATE: 2001-06-18
cttgttttatcatgtaattttcagaaaatatgtgatccataaagattaaaagaaagttgtattaagtctggcagctttagtattaacttgaaataaaatatggcaagctttccacgtcctcctttatttccacaatccatatgtacgagctagattccagtcagaacttccacaaatacttcactctttggtagcagcggttataaattacgcctttgctaatttgcgttgttcccaaccaggagaaacattaccacaaaaaaagtcagtttcatcctgcagtgttcccgcagcaaccatattaagctggaagaataaagctcctttgtagtagtagcgtctattgaattacaatgtaaatgttgatgcctcccctggaaacgtcaaatgacaacaggtttacagaacgaattcagtggttgtttgcagctctggaatcccaggctgcagagttgagatcgaagaggtgcgtctggccatcttagcgttcattcaaccaaatctcctcactccatcaaaaccacgccactccccacctgcccagctcgtaaaagga

SEQ ID NO: 2261 - DNA, 514 bp, Homo sapiens
  ref <308>: DATABASE ACCESSION NUMBER: Contig40845
  ref <309>: DATABASE ENTRY DATE: 2001-06-18
caaaatctgaaacagaattcattatttcccacagatgaaaataacagaactgtgattgagaaatggagcttaacctgtactaaaaagaatggcttacaacaggggtccccaaccagatataagccataatcacagatatgcttatttgcacagtagctgttgccgaatttcagtctaccatgtgcctattattcaccaaaatagtaatcatacctataccttttaagtattacctataaattcttgctccttatgaaatctcttaatcttccctgattttttattgctattgttgtttgtttttacaaaatctccttaccaaactttggggcacaaaggcctttcaggttgaaaaatttaaactgtccaatcaagtattggccaatattaatgttgtaaacctgtaggtctccttgtatctattctcaatattctccatagcaatttttctcactagtgccttgctcttttctttctcctgcctctatgcaaagccacaattttaccaatttct

SEQ ID NO: 2262 - DNA, 499 bp, Homo sapiens
  ref <308>: DATABASE ACCESSION NUMBER: Contig40889
  ref <309>: DATABASE ENTRY DATE: 2001-06-18
caattgtcacaaagcaataatcatttattttttaaagtcgtttacaggtatttataggcaaatggatttccactttaagacagataaagaatgtgagattaaaatagcatgcagacattccttttattgtttccttttgctttaactgtgtctgtggtatttttaagtgctgtatttaactactatactattacagtcaaatactgattatccatgtgtactgctgacaccatttacagtcattgcatctatttgtatcaggaactcttgctaccaagttaatactctgctcagctagagtgagaccacagccctgctctgtctctgataaaagtggttagactacccatacatttctactgtctatactcatgctgatcccctttttaaggacaaacgatcaagacctaaggtatatggaaaactggtgaaaaatacattaattctagttgtgtaaggggaaacaaatccatctaaaaaattaatggcagtagaaata

SEQ ID NO: 2263 - DNA, 450 bp, Homo sapiens
  ref <308>: DATABASE ACCESSION NUMBER: Contig41035
  ref <309>: DATABASE ENTRY DATE: 2001-06-18
tttttttttagctttattgactattaccaactttcagtatggttcaaataattaaatactgcaactgggacattaaaaatacaagctaatttaccaaaataattgtattctgaatattatgtacaatattatacattttacattacataatgggtttttatacataaaggtaagatttctgattattggaaatacaaagtacaactgaacaaaacattcctatgcgtacatacacaatcactcaactggaacaatcaaaaccatctatgagtgtggttattaaaaaataaaattacgttcatacaatggtagaaaatgaaatgtttttattaatttgattattaatacaaaaccacacatatatgaattatataacctagtgttatatatttaaaaatctttatgcttgcaactgaaatgtctctactccaagggaagtttctgattttt

SEQ ID NO: 2264 - DNA, 482 bp, Homo sapiens
  ref <308>: DATABASE ACCESSION NUMBER: Contig41234
  ref <309>: DATABASE ENTRY DATE: 2001-06-18
gcttattccagaagcaggtgtctttttcttgatagtgctagcccaaatgataagactatctctgattaacttcagttttgttaatctgcccattcctgaactaatcactatggctgaatgataggatactttggctagcctgatttgtgggcctactcctgtggtataaaaattagaattaggtaatgaacgattgcatctggagaaagagggacaggtctttattagggcacgctctgaaatctcagtggcctaacacaaaagaatgcgtatgagctgtagcacaagtgtccctaattggcaagcaagtatcctcccagtgaagagtcaggaaactctagcacaagtgtctctaattgggaagcaagtatcctccaagtgaagattcaggaaaccaggagtcctatcttgcggctttgccatctttaacacatagtttccagtgcaaatttgctcatctgcctcaagttgatggggagtgg

SEQ ID NO: 2265 - DNA, 370 bp, Homo sapiens
  ref <308>: DATABASE ACCESSION NUMBER: Contig41402
  ref <309>: DATABASE ENTRY DATE: 2001-06-18
accacttaaatgtattttattaagtagctcaaactcattatgagtactatttcttaagacatttaaggtagtatacatttttgctaaatggtgaaaaacaaattaactaatcatctaaatggcctccagattccatgtgtcctctttttcatgctttcactattgtcttccccaaattatctcctttcagcattcccataaatgcagctggcatgttttcaaatccttcaatgatatattccttgtactggattttaccctgatacaagtttttcgctaatgtattccagtgatggcttagcactcttcatggatttatagacaagattatttgcttgaagtcagtcaattacaaagtagggaagctcta

SEQ ID NO: 2266 - DNA, 495 bp, Homo sapiens
  ref <308>: DATABASE ACCESSION NUMBER: Contig41413
  ref <309>: DATABASE ENTRY DATE: 2001-06-18
gacataagaacagttttattttaatcacttaagacttgtgcattattcaattttgagactgaaatacttgtttccctttcaactgattaggaaatggtctgagctggcagaagttaatcctcacattattcagctaatgagagacagaatcctaaaacctgattccaacttccgcctgtacctcacaatgcaagacaaagcctttcattttaatgttgtacacatataaggaccatataatctggattaactttaggtaacaataacttaaaagataggaaaatgtatcatattacagagatttaaaaattgtctatacaataaatgatgaagaaaactaacaacaaacaggacgacgttcaaatactgaatacaattaacaaatggggccaaaagatcaacatttatctctcatcatctttcatgcaatgtctcagctttcttctcccaaacataaaggcagattaattcaaagtagccctattaagaatattt

SEQ ID NO: 2267 - DNA, 459 bp, Homo sapiens
  ref <308>: DATABASE ACCESSION NUMBER: Contig41521
  ref <309>: DATABASE ENTRY DATE: 2001-06-18
ccttcaaatgttataatttatttcagcttcagaaatacagcttcacattttcacaataggtacatgtgaccttcaagaacgatacaggctttgagatttttcttcaaaaattccattctaagagtccatatatcagcattaagaaatcctgaaagtgccaagaagacagtggaaagtatccggctcatattaattaaagaatcagcagagaagacaagattttacttctgtatattccttcttcaaacaaagcaaaagaaaaatttgacccaaaaaagggaaagtaaaaatagacaagcaagcaaaacaaaggctgtacatgtacataggaaatataacacaaatcaagtagtactggtggaattactggttggggggaataatttttaacaaactggtagcagacaaggcaagtggttagacagagtaatttttgtcataattttaaaacatttcata

SEQ ID NO: 2268 - DNA, 484 bp, Homo sapiens
  ref <308>: DATABASE ACCESSION NUMBER: Contig41530
  ref <309>: DATABASE ENTRY DATE: 2001-06-18
gaaaaagaacacatatagtttaattgatactttgccaatacaaaaataagcatccacagaatgtttatttactgtttaaattactccatattttcatatactgtgaacagaaaatatattttaccccacatatagtaaaagcaaacaagtgcaatctttcaaacattaaaatcataatcaaatctgtacaacagataaataaatgtatacctctaacagttagcttgtaaaaaaaaatcaaacaaaaagcaaaaacatttattgcccaaattcaccagtttacttaaaattctacttatggtaatacagctcaatcgtaacaacttgcatgtttactacactgcacaagtttagactgataaatatttaaaataggaggtgggtaataggaaataccaaatggctataaagagctttccaaatattggaaataatatacgaaaattaattagtggggatacctattaaatggatccacagggta

SEQ ID NO: 2269 - DNA, 633 bp, Homo sapiens
  ref <308>: DATABASE ACCESSION NUMBER: Contig41590
  ref <309>: DATABASE ENTRY DATE: 2001-06-18
gaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaacc

SEQ ID NO: 2270 - DNA, 453 bp, Homo sapiens
  ref <308>: DATABASE ACCESSION NUMBER: Contig41618
  ref <309>: DATABASE ENTRY DATE: 2001-06-18
gcttaaaacaagcacatatatttttatgtacctatattacaaacacattaaaaaatgtctgcaagatgtatatgttttcctttacacagggtactggaattggaagtggagataatgaaaggaccctttactttcaactgtaatattttatttaaatgtaaatgtattcatgatttagcctagattaaaaaaaaaatcagctagctagaagaatgaggtaacttttaattttagtactaaaggataaacagtatttcacccaacagatgaggggggaaaatatgaattagaggacatgccaattacttagagataagaggaagtcaagactttctgaaaaccaaacttccaaattttgcctataccgccaggttagttcaacacaattcaacccaaattactaagtacctaatgtgtaaaaagaattgcactaggtgttgaggatagatcctg

SEQ ID NO: 2271 - DNA, 578 bp, Homo sapiens
  ref <308>: DATABASE ACCESSION NUMBER: Contig41624
  ref <309>: DATABASE ENTRY DATE: 2001-06-18
cctttgacagtgaccatttattacacacatcagactgggggaagaccattgacatagctgagcaccaggtagggtgtcctgggtattcgggcatgagagcagcaggggcctcctgacgcgggcaggagaaacatggcacccaccaggaggaggaagaggaggaagaggataaggaggaaggtcagaggctgcctggatgcaggatcgggggcccctggattcccctccagcctcacatcctggagatgaggagatgcttgcctcttcttgtcctgaggcttccggagcagggagtgtctttggtgacgtgctaagcgtttctggtggccgaggccagactccagcatgtcctgtcgggagtgagaggtgtctgcttcctcaaggccttgtcccctgccctggggccccctgtggccacacagctcacagggcactcctagtgtccgggctgtcttttgtcccaagggcccaaggcccccaatgtcccccgccggatcccactccaactctgtggaagtggggaggctactgggtgcccagggcccccagaccccaccaggtcctggccagtccgagtc

SEQ ID NO: 2272 - DNA, 402 bp, Homo sapiens
  ref <308>: DATABASE ACCESSION NUMBER: Contig41635
  ref <309>: DATABASE ENTRY DATE: 2001-06-18
atttggaagcaaaatttttattttttaagaacagagctatttcataaagccagctacaacatctgtggtacaaactcatcccagctctctcgccatattccctctctgtagacccagagaccatatccataacccaaagggacacagggagggcagacagaccttctttaggagagaagtttagaaactgatccacttcatgaggctccagcttaattttaggaataatggtctggcacgaggaatcaaccccagtgttcatttccagaggaggttcctccttttccaacggggtggagatggctgtgatggtcagagtgacagacggaacgagtcctgggggtggttcgtctgtaactggctctgtcttgatggatgttgaagggaagtctgtagacaggt

SEQ ID NO: 2273 - DNA, 607 bp, Homo sapiens
  ref <308>: DATABASE ACCESSION NUMBER: Contig41676
  ref <309>: DATABASE ENTRY DATE: 2001-06-18
accatccagtcaagtttattaaaaaaatacagacacacaaacttaagaaactggaaggaacaaaatgttcatgatagcttttttgtgagatggtaggattccagataaatgcttttcattttctcccttgtgcatctttgtgttctccatattttccataatcaattatgtttacgatcaggagagagtgctgagagaagaacagagctggcgtgaatgccctgggggataagggctgatggcaggagctcatccttgcagcactggtgacagtggctgttgggcaggacctgaagctacgtgcacagtcgtccccgttgcagggtgggagaccaaaaccccaggaggacatccaggccactcagtgagggatggatctgaaccttgtcatcgtcctcgcaggtcatgacattggagaaggggatctcggccttgaacattttccggcagtgcatgagctgcaccagcaggtagcagacagtcttgaacttcatccttttggccggttttatatctgagagaatcaggcctggaaatatctttcggcgatgggatggcacaataaaaaaggtttcgatgttatgagttttcaagaaactgttcctct

SEQ ID NO: 2274 - DNA, 462 bp, Homo sapiens
  ref <308>: DATABASE ACCESSION NUMBER: Contig41689
  ref <309>: DATABASE ENTRY DATE: 2001-06-18
gaatgtaacaagcatttattaaaaactgtgctgcacaaaacatgttagaaactagccaggtgctaggagtctaatcaaggcaggggcagggtaaaaacatgggaatattacatggacaagcttgtctagcatggcagtctataacccttgagggtttacataaaataaaggaacatttttgtggctcaggctccccagagttctctttatgtttgggcagagactgccccatcccttagtgatcccaccttagagccaggttttcaaagtcatttctcccagtatatctgtctctgtatgcaagtttcctctggttgccttgagcaaaaacaatcatccaactcaaatttgctagccctatgctgggccagcccacgttcccgtaggacatctgtaggctaagtaagccccgggtgatctgtgtcttggtcttcctaattccgttgcagctcttcctctctc

SEQ ID NO: 2275 - DNA, 493 bp, Homo sapiens
  ref <308>: DATABASE ACCESSION NUMBER: Contig41804
  ref <309>: DATABASE ENTRY DATE: 2001-06-18
caggtttaaaatacttacagctttattaggagaaggctgtggtcacctcagcagccagctcccttgtatacacagtatacacagcccagccagcacccaggtccttccatccttctgcagtacatggagtgcaaaagaaccaaacacaacggcggggagggagggtctaccaatgagtgtcagtgtctagtgcttccgggagccaactgccaggctagggacactcaagtccctcaaactgtcatcagctcctgccagaccccactccagcatgtcgagtgtttgggccagactcctccaatcagtgcacgcgatgggcagaggaggctagggaatcctgagcccaaagctgtattggtccatccccctcaagaagttgttggagctttcagaacgttcctcttcttgtgtagacatgagataccgctgtaactttactccatcaccagaaacctgtgccttgagtctagtctctgctcagccctcgagagca

SEQ ID NO: 2276 - DNA, 552 bp, Homo sapiens
  ref <308>: DATABASE ACCESSION NUMBER: Contig41887
  ref <309>: DATABASE ENTRY DATE: 2001-06-18
gcactgattctgcagaagctttatttattggtggattcagattcagcgtcccgactcagttactccagtaccatcagccaccaccacacagatggcctcagctcggatggccccataccccaccctagcgacccacgggtgagtttgctgagtatgtgagattaactggtggctcagtggtcggctcctctagtggataattccattcaaagccaatgctcttgatgccaaggagttgatactggccatagatgcccaccagcacctgcccctcttggctggggtaggcagaggagatctggccatcaagcttcccaaaatagaaatagcggtccttgctggtgtacatgaccataccccggaggaaagcttggaaggcgacaaagacttttgtgatgtattcgcctggctgcagggtgacttcctgggtattcccacctaaggctcccagtttcacgtcccaggagtctccaagtttcacctggacacttttcaccaggagaagacctacagacacccgcagccctgtgatttcatggtcgtagtcttcag

SEQ ID NO: 2277 - DNA, 654 bp, Homo sapiens
  ref <308>: DATABASE ACCESSION NUMBER: Contig41905
  ref <309>: DATABASE ENTRY DATE: 2001-06-18
acactaactccgggtagttagtgtcacaattgaattgtagatactcaattggtgtccggaagaatcagagaattggttgatggtgttggaaaacaccctaccaatataacacttaagttcatttttagcataatatctgactgggttttcagatgttttaatattagagaagaaatggtggtgtaagagacaaagaaataacaattatgcataaaagaattttatttagtggccagatcccaatgaataatgtcagtcattgcttggttctgctaaaatgtggtattagatatattcttaagaaagtgtacaattgcatcaccaaaagctgtttaatttggattgtgtagaataaaagaaaactacataagtctttgttctttgataaaaattttaaaatataaaaatgaaaaaaagaaacccaaaagcagtattcaaaactaacaaatgtcaccttggactatttacagtaagacgcctttttgacaggagaatcttgttctcagcttgttcttttcctcacattttacttacagggattctcactcccccatctgatccctattcataacttcttccattcctgtctcacatgaaacagccatcttccatgctctctcactcatctttgagtctctctctgacactcctttt

SEQ ID NO: 2278 - DNA, 585 bp, Homo sapiens
  ref <308>: DATABASE ACCESSION NUMBER: Contig41954
  ref <309>: DATABASE ENTRY DATE: 2001-06-18
agatccattgacttttattacaaatgtacttgatcacttggcttcaaaaagtttaaaatcaataccctattttctgtatgccagtacaaagcaaactgttttacaaattaaatacctaaaaatttgacaaaaatattaaaatttgatgaaaaacaattataaaaatccttaatctctctcttcaaaaaaggaggcagtcttcccactcctattatacaatattaataatattcaccatttttagaataggtagctaaattatatctttctgttagcatacaaaacttagactaatatatttgtatatgctccagttaagtttgtgaatgccatctgattgcaatataatcaactatctttaattgaatcctaatttacacttatttaataatttgcatagtttgaaagggataaaggttattctacaactaattatcataggctattacagtgctacttttcaaggcaataagtatttgctcccaaatgaagtatatgtcttctttaggcaggggttaaaattactagcagctttctctattacctgaaaaatcaaattggaagttatccatctctctagatgtg

SEQ ID NO: 2279 - DNA, 364 bp, Homo sapiens
  ref <308>: DATABASE ACCESSION NUMBER: Contig41983
  ref <309>: DATABASE ENTRY DATE: 2001-06-18
gttgagaagtgtttattgtaaaaatggagtttataatgaaaataaaaaattatttcataacattctgataccactacacctgagttcgatgccagcatggtttgaaagtgaagctgatacaagttttctaaaggatgttaaaaaactatagtatgaagaatgtaataatattttagaagacattaaaacttaaatatttagatgctgtatatgagaaatcacaccaagctctcttaattaggttaacattagacaactacatctcaatttccaagcttccaaaaataggtaaaaaaattattttagtttaagttgatattaaaaacacattgggagcaggaatccattctttcaggttttaaga

SEQ ID NO: 2280 - DNA, 582 bp, Homo sapiens
  ref <308>: DATABASE ACCESSION NUMBER: Contig42006
  ref <309>: DATABASE ENTRY DATE: 2001-06-18
tcttctgagctgtttacaactgaccactgtgttccacagatgtatttttcaatagctttttgttacttagttttccatgatgcctgttatttttctcttgtaaatttaaatgagctgactttaaggatcttgggaaaacccatggcataattacaattttctttttaatcgacttttcattacttttgggagtctgttggtaactaaagatgtcaacaaagaataaattggagaagttacctgtccccactatagcagtaaacaaaacagatgaaaaacaccttgctgttaactcaatggttgatctaattgtgaaatcgttcaccttgttaaacatctaagtaagtctgtagtcgctctgcaaacagccattatatttatttactctagaagaaactgtagagtagtaattcgtgctaatgagaaaaacaaaataccatgttcaaaacagatgtatttgaaaacttaatgacatggttccaaaaactagagcatgtatgtatgctgtgcatcatctcagcagacctaaaatatccccaagttgtccctttacagccatcaatatattttaaactctgcggc

SEQ ID NO: 2281 - DNA, 612 bp, Homo sapiens
  ref <308>: DATABASE ACCESSION NUMBER: Contig42014
  ref <309>: DATABASE ENTRY DATE: 2001-06-18
aagtagcataatgacctttattaatcactgcatctggtgtttgccaaatgggagagaaacaatactcaagcagccttttgttaaggggtaacaagttatctgaatgaagatacttcagcacatttaaattatatttaaattatatcaagatagtgctataaacatttaatttcaagtagcattctcaataaaataactcattgcaaacctaattgctctctagagaagattactgggcagtctgtttcagtaataacataaagcaagaatcgaatcctctcagtaattaggtaacagattaaatttatcaattatctactatctgttatctcacttagatgataagccatagagaaacaaataccaggcaagctcatgaaccaccgaattcttcagaattattcacttttctccaaaatgattaatgaattgcagtccttgccctcaagaagctcacagcttaataaagggtacgaccctctagaaaataatcatatacacatacgctgtaagataataagtaaagacatattcaaagagctactctaaagcatttccaggtggaacttagtacctctgctctaccagttcccagctatcccctatgataca

SEQ ID NO: 2282 - DNA, 415 bp, Homo sapiens
  ref <308>: DATABASE ACCESSION NUMBER: Contig42036
  ref <309>: DATABASE ENTRY DATE: 2001-06-18
atcctactgcatgaactgacaaatttctggcattcatacatatttaaacatttagtgctaatatttgtacagaaaaaagttaataatactaaaacatatgttactatgatttcacttttagcctacatcatatactaatttccccttttacatgcagctttaatattgtccaaacaatggcacaaataaagaaacaaagtcaaccatctattccccactgcccaccaccccatccccacatcaaaccgttcaggactctcttccccagccgggctggagtggccctcgggctgctcagtgagacccggacccaaggccactggagcgagggagctgattcctcctcctctggggcacaccttcctgtaaacgtggctggggcaacacggccccagagccaagggaagctgctctc

SEQ ID NO: 2283 - DNA, 368 bp, Homo sapiens
  ref <308>: DATABASE ACCESSION NUMBER: Contig42041
  ref <309>: DATABASE ENTRY DATE: 2001-06-18
gcttaacacatttccatttattatttttaataaagagtttaagatcccattttttaaaaagtacaatacagttgattttttaaaatgaggttctacaaacacttttggacagtctaacatacatataagctgtccctttcaactaggatatggggaaaagaagtcaacccagtgtttccactttccatgaaggacttctcaagggcaaggtaataagcaggaataaagcttccaaaaacctggaaggactctttcaggtggactaataagcatcatcatcacctgccttaaactacagtaaagccaagattgttaataatatagttccttgcttttagctagtatagaaaataaaattgaatcacatt

SEQ ID NO: 2284 - DNA, 509 bp, Homo sapiens
  ref <308>: DATABASE ACCESSION NUMBER: Contig42139
  ref <309>: DATABASE ENTRY DATE: 2001-06-18
agacaaactaactgaagccacagccggaagcaggctgaccacaagtgctaaggttctggttagttcttttctaggttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaaggattgatcaaataaatatatcacggataatgggagctggattcctcactgcctgagaaaagaacacaaatagagaaagggagaaagaataaaccctgtaatgctgaaatggaattaaagggaccagctctgtgaacacggcaagtaacaacagagagaaaacgtgaggagaaaagagagaccgggattttgaaatcctgtttcctgaatgccatctcaccaggcacacgaaagaataaaattaagg

SEQ ID NO: 2285 - DNA, 755 bp, Homo sapiens
  ref <308>: DATABASE ACCESSION NUMBER: Contig42161
  ref <309>: DATABASE ENTRY DATE: 2001-06-18
agaacagtggatctctcttccactttaggaaaatgttatctgtctagaaaaatggccatttttggtagcaaaacttaaatgtgtaactgtgaaaaatgcacgtttaaattagtagaaaaaaaaataacaatgcaattctccttggctagaatgtttttgttcctccttgaaattttaaatcaacacaacgtagcaaccctccctgcccacctcagaaaaggtcacactgtatgcactgtatgaaccttgtcaaaattctacgtattattcaaaaaagttttcatgccaggatattctccaaattcttttttcatttttttttctggagagtgctctattctaggatttaattacacttcaaacgtaattgaaatttacctaccctgcttgtccaaacaatcaagagccacttccataaaatctaaactactttagatataaaccatttttaccaaaagtcacatcatagtcacaactgcaaactggcattgctatgcaaggctggcagtaaacattaacattagcttgcaaaattaatacaggcctacagtctgataactcttctagacccagcctgattcttatcaggctatggatgaagaagtttaattaaaactcaatccagtctagactgtgtgacctgttctttgtgctattactgttcagtggcatcaaatgcatcataattataggtggaaaggctagtaatgatgccagcaacttgtttaaatgaagtttttataatttttaaagct

SEQ ID NO: 2286 - DNA, 453 bp, Homo sapiens
  ref <308>: DATABASE ACCESSION NUMBER: Contig42220
  ref <309>: DATABASE ENTRY DATE: 2001-06-18
ttggttataatagctatttattaccataatgagaaatgaacaaaagttttacagtgagatgacaaagttcaaatattatctgtagtatacaagaactagataaaaaaaaaaaaacacatggtgcaaaaagggtgcctactatttaaataccctatacctgagttacaaatcacctaagcacaattacaaataattcagcctagcacccatgcaggacactggctagtacatgggtagccagcagagcctcttagcagaggcaaaatcaattgcatttcaaggaaatagtctcccagcatcagaatgcagagatggatgctttcctcccctcacttggtccctaattgttctctttacaacactagcagatgttggggctcagaaaacccaaagtgaaggcctcagaagcaaagtttttctctgatgttatcctgccctcctgtctcagcctca

SEQ ID NO: 2287 - DNA, 661 bp, Homo sapiens
  ref <308>: DATABASE ACCESSION NUMBER: Contig42306
  ref <309>: DATABASE ENTRY DATE: 2001-06-18
gacagcagaagtctttttattcaaatctcccaccttacagatgtccagaataatcaacatatttcaaagggtatatttcaaaaacgtactagcaactcagccagccactgtcacatggaataagaagacatgccctggccattagaaccatgctgtcctcgctcttgtgtccctccacgggacagacatcaccttgcaagacaactcgtgccactgtccccaacagttttccacagagttcttgtttcccttcatctgaatcttctctgtgcaatttgatgtcctgaactatttctgacggttgcacacaagatctcagggactggaccttttagttatgagaccagccctcttagacagcagacagtaggtacagtgcttgctctcccttctttgcatccttccagagttgccttcatcctcatttcctgcatctggtaaagtctctctgaaaatgtgaaaccgacgacagaacatggcaagctggatggagaagccgacaacccctcccccactctcacccaacgccgggccggtcctgtttcggatcctgcacactgtggaagcttcttgcttccttgttttggtgggtgaaatctttgctgttcaaaaaggtgtttttgcacagaaattttaggacgtgtttattctagtaacgtag

SEQ ID NO: 2288 - DNA, 557 bp, Homo sapiens
  ref <308>: DATABASE ACCESSION NUMBER: Contig42311
  ref <309>: DATABASE ENTRY DATE: 2001-06-18
aaatgtgctaagataaataactttgtatatttgtaatttttaaaaattttaatttccaattttgccaagttcagaaatacatacaacttaaagcaaatagggtacaatgttaacaccaggtgagggttacatggtgttcactctactgttttacttttgctgtagatttgcaatttttcaaaataaaaaatgaaaaaatgtttataagacaaagtctatgtcactgagtatcactagttttagagttaaaaggtgccctgtcttataggtaaaaacttttctgctaagagaagcatgggagaaatatttgacatgcattaaaggacaaaactggtttagaagccaataaagagagaacacactgcatgtaccaccctcatcatctcgagttttcaaaacaagcatgttcctcttgctccaacagactcccatgctaatcatgcaaaaacacagcaatccaccaacttccacatttacaaatgatgataaaagtttaaaaacatatctctcaataagatgaaaatgttttctgactttgacaaataaagttttctcag

SEQ ID NO: 2289 - DNA, 486 bp, Homo sapiens
  ref <308>: DATABASE ACCESSION NUMBER: Contig42313
  ref <309>: DATABASE ENTRY DATE: 2001-06-18
tttgacatattaatcctttattagaaattgtaaatgagaaattatatcaacacctgaggaccaaactacaacagaatattccataggctcaagattttgagacattctggaaagagttttctgtaaggtatatcctttccgtggcatggcaacatcatcattctttaaaaaggtgactggacagacatcatttccaccatcaccaatataaacaatttgtgtataattcactccctgttgtaactgtttatctacaaattctatcaaaactacctttttgcaaagattctttgggcatctattgcaagaatgagtatgataattttcaacagtgagatgaccattgctattaaaagctgctggatttgtaaacactttatcaaatatgtcatgaaaactggcagcttctaaaacccaatctatgaagaccgaatttgaatctgaaataataatgcagtcaaatttatccttattctttcttataaa

SEQ ID NO: 2290 - DNA, 467 bp, Homo sapiens
  ref <308>: DATABASE ACCESSION NUMBER: Contig42402
  ref <309>: DATABASE ENTRY DATE: 2001-06-18
ccaataacttaatagtttattagtcagtcaacaatattacaaatatttaaaaattacttaatataaatagttggcagcaaactattccattacagagttaaattaccagtacaacagacagactggagatttagacacctggaagataacaataaaataaactaaaatatttaacgaaaaatttaagctgaaggtgtttacctagtgtccataaaagcatgggttctctttttatttagaaaaaaataaaaaacggctttaacaccccattaggaatataaaataaaatcaactgaaaatattaatttgcatatcaaagaaccatttataattacaatccaaacactccataaaccacttgtgcgattctatacagaaactgggaattagaaactagttgctttaatattacaaagatttcagctccaaaaataattcaacataaaataaactttagcaattagtgt

SEQ ID NO: 2291 - DNA, 487 bp, Homo sapiens
  ref <308>: DATABASE ACCESSION NUMBER: Contig42421
  ref <309>: DATABASE ENTRY DATE: 2001-06-18
gccatgaattcctttttactgaaataccgtaggactcactaccacaataagtacttaagctgaaagagtttctaatgggagccaagtaaattcagctctccactgtgcaaagcatcttgtcatttctataataaaagtctttccatgttcagtccactttggctctggaacctggatgagtcatgcttggggcccagggtgcctgtgaggatgctgcatgagaatttcagctgtggtggcagtggctgggagtcccactgactcagggggaggccaggcgagatgagctggaacttttaggggagagctggcacttagggacatcattgattgtgcttttcttagcctagttctgtcctgcaatttatttttcttatcatgtgactgtcggctgaagtctggggtcatttggtttctttttcttcttccttgctggacagtctccatggggtcacggttgtctaggtaattaaaacgaatgatatct

SEQ ID NO: 2292 - DNA, 676 bp, Homo sapiens
  ref <308>: DATABASE ACCESSION NUMBER: Contig42430
  ref <309>: DATABASE ENTRY DATE: 2001-06-18
atgtaattgcctgtttatttagtggcaccagttttccaaactagaaattatttctacttttcatctaacatacaatctgcaaccattcgcaggctgaatgcaatttttcaatgaacttgaaaacaaacagtacattcttaaagttagaactgaattcacatattttctttggaccaggaaataatacataatacaaaatatacatttatggaatttctttaaaagtgtggatcacataaactgcaaagtgggtgagttgctacggagaattttgttacacattgtatttaagaaaaatatttctgcaattatattattcttaacatttatagagtttaaaaaatgaatatataatgcaacatgcttttaacatgtacatgtctctccactcataacatttatacaaattaagtgatataactcatttcaagagtgaaatcaatcactattggggcatatcactacaaacaagatattttcctgcagatatgctatttagtcaagggataaccaggtaagataatggtttctatgttccagaagtcccacaaatgggaactaaataagctgtcattaaacatctaattttggcaacaaatgcaaaattctatacgtttgttacattgtacttatcatattttagaaatctcattaactgtgtgcattggtggtggtt

SEQ ID NO: 2293 - DNA, 370 bp, Homo sapiens
  ref <308>: DATABASE ACCESSION NUMBER: Contig42431
  ref <309>: DATABASE ENTRY DATE: 2001-06-18
gattgggtaaaatatatacaagataatgctatacttttaaaagagaaaaagcactttacattgtttaggtctttggatctgcatatgtccctgaggtaagtattccagccatgggaaactgaagcacagagaggtagtcacccaccaaagctcagggctggcctccagagcttgaacccttgcctgagctggggtcaccagcctgggtgggccacggagcgatcatcatttctccatctgatcggaaagtcacccaccactctgttctggggcccagcccgcctggctccaggcaggctcggaggccgtgctctcctggacctggtgcatctggctgcagccagcactgggcaggaaaataccgctggag

SEQ ID NO: 2294 - DNA, 472 bp, Homo sapiens
  ref <308>: DATABASE ACCESSION NUMBER: Contig42542
  ref <309>: DATABASE ENTRY DATE: 2001-06-18
aacttccttcctataaacaccttcagtcaaagaaagccagaggagatgcactgagactgaaataacatctgttgactaccagacttcactgaaatcggccgtctgctctcctgagttggcattgttgctaagataaagcaaatgaaattgaagctgtactcttgatatttacaccatacaagactaggctgttagggttgtcctgtgtggtctgcagccagaggttacactgtaactaccatatgcaggccagacattcattctgtgcttagggactgaattacactataaggtgtaacactggaccgaagacttttccattaaaaaaaagtgctgcttttctaattctttatattttccaatactcattcctaaaatgtcatgaaatggtacctaaaagcaaagtactggaagataatcacatcatgtcacatttggtcttaatataagacatcagaacacatctttaaca

SEQ ID NO: 2295 - DNA, 369 bp, Homo sapiens
  ref <308>: DATABASE ACCESSION NUMBER: Contig42582
  ref <309>: DATABASE ENTRY DATE: 2001-06-18
ccccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacattt

SEQ ID NO: 2296 - DNA, 412 bp, Homo sapiens
  ref <308>: DATABASE ACCESSION NUMBER: Contig42631
  ref <309>: DATABASE ENTRY DATE: 2001-06-18
gtaaccggcattataaaatggttttattaattattaataactatttaatgtgtacacagttatccatgaagaaataggaaataccagtgagttgttaccagcgttgccccaggctgggagagcccttccagctttcctttggcctctgacacccctgccccactgaccgcccaccccccattcctgtctggaaggctcgcctgccatcatcccgcacatccgacagctctcccttcagggtcacctcctccttggacaaagcatacgtgaccccttgtcaggtttcttggctgggtgctcccccagagtttggctcctgcccccaaccaagcatgcatggtgacaatgcacccacttgataactgatcactggtgtcacttccacctccctccctccatgagcgcaaacctc

SEQ ID NO: 2297 - DNA, 491 bp, Homo sapiens
  ref <308>: DATABASE ACCESSION NUMBER: Contig42751
  ref <309>: DATABASE ENTRY DATE: 2001-06-18
tggaaattaagaaaccaaaatctttgctttcatgtttattaaagaagatcactaaagatattgactagagaatgctgtgtgctatttcaattacatttgtttttcttttattaacaggaattttgattcttcaaggaagtggctcaatttcaatttcaggtgaccaggtttatcgtgacttttccttcttgtttacttttcgctaggaaggggagttgtaggggcagattcaggtattggaataggaaaattacgtctaaaccatggaaatcttggaaatggaattggtggaagtgggcgaaatggatatgggtaagggaacacaaaaaaccctgaagctaattcatcgctgtcactgatacttcttttttctcgttcctggtcttgagagactgggaaaccaacagccactgccaagatggctgtgatcaggaggagaactttcttcatctcaaacgtttcagtcagttctttctctctgacgctgttat

SEQ ID NO: 2298 - DNA, 493 bp, Homo sapiens
  ref <308>: DATABASE ACCESSION NUMBER: Contig42759
  ref <309>: DATABASE ENTRY DATE: 2001-06-18
ttttttttacttaaagtaaatgtggctttgttagtttctaaagaatgtacttttcttgttttacttttttaaaaagtcttttcatttcaaaaaaaaagttttgcatttgtctcaagagactcaaataggaagatcagttttcaaggcactcacatcaaattgaatggcagtagaaaaactgtcctataaattattattttattttgttctttatagtgccagtattgtgaatgccacgcttagcaatactgacactcaatctcagctgtcccttacagtttaacccacctctgggccaaagagaagaatatgctgcaatttcttgtttagaagccatttaatttaaatgcaaacaaaagctttaaagtgcgggtcaacagaattcaaatgtctaatcttaacagttcaatatttagtaccttccaacctaatgagataggaaaaaaaaaataaaaacctgggaagtagcgctgggcaccttctgatggaactc

SEQ ID NO: 2299 - DNA, 467 bp, Homo sapiens
  ref <308>: DATABASE ACCESSION NUMBER: Contig43054
  ref <309>: DATABASE ENTRY DATE: 2001-06-18
agaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctg

SEQ ID NO: 2300 - DNA, 545 bp, Homo sapiens
  ref <308>: DATABASE ACCESSION NUMBER: Contig43079
  ref <309>: DATABASE ENTRY DATE: 2001-06-18
cctggggctgttgacctattctgaggattgttcagggtatgcattgagtttcctttcttcactaccaacgcaggatttttatcctctctactaattaattcttctaagaaataatatataaaagaacaaaaaaggggtgaaagttcagttagccacacggctggctgctttttaggagtctggatgctggctgaaaatactgggcaaaaagagacttctgcattcaggcaggctccggaggatatttcaattatgtgcattccactgtcctgtcctggccgagttaactgcatatgtcaggaaaaagagaataatcccccaacccccatctgtctcataagagaacccctttttcctatgaagctaaaacacaccacacagctccagcaatggggagccatctgtggtgtcaaccgaggtggccacagtccctgaatggccacggatgtctgcctgggagtcagcccgacccattaacatcctcgatccttctggcttcagtgtttaggaaccatagtgcttcaggctcaatctttcactctctg

SEQ ID NO: 2301 - DNA, 443 bp, Homo sapiens
  ref <308>: DATABASE ACCESSION NUMBER: Contig43195
  ref <309>: DATABASE ENTRY DATE: 2001-06-18
gtttgacgcctgctcaaatatggaagcacctttaatgagagttgacatgacttgggggatttcctaaccatcatgctcttaacacaggtgcctggttaggcaggttccttccacctggctgagcccagacaccgatctgtgagagcagcacagtgcaagggaaggctccctgcaaggagaggctgcaggctaggctggcccttcagggtagtgttttggttctttcctgaagcaggaggcctcgcttggagcattgctttgctcctaaattacttaaccaaacagcgacttattttccacagtcaggtagacaaacaccacaatgatgaaaataccaagcacagcaagcttcaagcccactgggaaaccttcttctctccagctctcgatagtctggtcttccgcgcagtagtctctctctttggtgatagtcccatatgtga

SEQ ID NO: 2302 - DNA, 398 bp, Homo sapiens
  ref <308>: DATABASE ACCESSION NUMBER: Contig43368
  ref <309>: DATABASE ENTRY DATE: 2001-06-18
catggcacaaataaataatctttaatttcaataaatagctccccatcacaccagacattatgctgtggaaaaagatacagaagcatccaacagagagagaggaaagagagagagagaaagagagagagagagagatctattctaactacactaattccttagcacgagagacgtgacattcgttcacagaaaaacacagaaagatcctcagagtatgattaaggaagaagatcatcatggatggggtgtgatagccattttaatccatatatcaagtctttgtatgtctttcgtgggtcacaatcaccatgattcggtcaaaaaatgttacttttgctctatcatatcctatttactttacacacacacacacacacacacacacacacacacactac

SEQ ID NO: 2303 - DNA, 345 bp, Homo sapiens
  ref <308>: DATABASE ACCESSION NUMBER: Contig43410
  ref <309>: DATABASE ENTRY DATE: 2001-06-18
aagtttgattttgctacattgaaaaaatgtttgtgtgtgtgtgtttttttttcctttacaaaactccttccacagacgcccggggcctgtggcgggtcactgtctgggcagatgctcacagcagcacgtggtgcccacagagttcaggaggctctggtaggggctgttttagaaaataactgatttcctgttgaatcaggtacgctccgtgcgaccactcctccctccctgctccctgtccagttcgggtggtcctggctttctggctgtgggcagctgagaggacaaaagaaaggaagaaaaaagggaaaagtaaaccactgccccccagttgagccaggttcc

SEQ ID NO: 2304 - DNA, 548 bp, Homo sapiens
  ref <308>: DATABASE ACCESSION NUMBER: Contig43476
  ref <309>: DATABASE ENTRY DATE: 2001-06-18
cccttatacaatttataatctcttaaaggaagcaataaacatttaaactattggactactgggatgtacattttaccagataccagcatcataatcttataactctatatgaaagtttgaaaaaataattataaagtttatttaaatgttgattgtcccaaggtctacagtttcttttctgttgtgtcatcagtgacaaagagtaaaaaaaggaaactcccatatttagcactttagagtaaaacacatggatcatcgttattaacagtcctctgggcgtgctggagctcactgagaaggcttctattttgagcttggaatgttgtgctgagctgtgcagcctgttcctgcatctgttgttcctgcattttctgttgctctgccagccaattttgtttggctatctccatttgtctcacttgttcctgatggagtctctccctctcctgcatcatttgctcgttctgcctttgaatcgccgccaacctttgcgcttcagccttttcagcttctgctttcacttgtgcctctgaggagaaaaagataat

SEQ ID NO: 2305 - DNA, 391 bp, Homo sapiens
  ref <308>: DATABASE ACCESSION NUMBER: Contig43549
  ref <309>: DATABASE ENTRY DATE: 2001-06-18
aattggctatgggaatttcaatttattgcataaataatcttttagacctcaagatacacgtgacctagggacagtttacatcaatgggcaagacttaaaaatagacaccaagttcagcaagtatttgagcacctactaaaaattacacaactcccacaacaacgcattttgcgtttctaaagttgtaagcagcatgttcggacgcttgatgcaatttcccaagttgtttgggccccccccccaaaaaagtcttctcagtaaaaggtggggggaaggagggtattttgggggcaacaaaccaaactggtctgtcgcatgttaagtcaatttcacgttcacctactggtcaccacgaagccgaggaaagttttaaaaagaacattccggggtc

SEQ ID NO: 2306 - DNA, 398 bp, Homo sapiens
  ref <308>: DATABASE ACCESSION NUMBER: Contig43645
  ref <309>: DATABASE ENTRY DATE: 2001-06-18
agattagtaaaccacagcaaagtttattcatgtgccagggacataaagatacattaattgtttgtttttctaggctgccagtataagcttttcaaaatgtttaaagtaaataaaaccaataatacagctagataccacattgcaaagaaccctaatgctatttatcagctttaaaatactttcaactgaaatcaattacattttaatatacacatattatacagaaattacctatagctcttttaaaaatcctatgacattaacatgaaactttattagaatttaagattctatatgcagacctgataaagccttaaatttaattattttggagtaatgtcttcttaagaaatggtagataggataaaataatttacagatttatctgcctttgaact

SEQ ID NO: 2307 - DNA, 420 bp, Homo sapiens
  ref <308>: DATABASE ACCESSION NUMBER: Contig43648
  ref <309>: DATABASE ENTRY DATE: 2001-06-18
ttttttcactttttttccaacatataaaaaggtagcggagttgtctgtgggtttttttttttttttaaatggttaaatctttggtttgtttcttttttctcttggaggcctttatctctcgcacttgcctttcccactcagagaccagtgggggcccgcgtgtctcaatcttgctgtctgtctcactctctctctcactcaggtccccctaccctgggctagaggaagagagaggcaccctggtgttcatgtgggttagaaaaactagtcaggtcaagaggtcaccctgacttggctagtccctcgccagatctccccagggcttggagagcccgtcatggccttctccagggagatggatggaaaactcatatccttcccctcctcctgatctcagccccaactcctactggggcttgg

SEQ ID NO: 2308 - DNA, 496 bp, Homo sapiens
  ref <308>: DATABASE ACCESSION NUMBER: Contig43673
  ref <309>: DATABASE ENTRY DATE: 2001-06-18
aattgctaagaattttatgtagcaagtttgtttattcagtaacataatcacaaaatagaaatatcacattcacagaagtggaaataaagagcataaaatatttttaaaacaggaaagcaatgggatcactttcaagagcctcaaagaaaacctttaatttacaatgctacgctttcatgattaataggattaatgtgtggtttttctttgataaaagtagtcatgattttttagtattacatacattcattgcatatgacagactgataaaaatgtactgttctaattacttaattgttttggctcatttaacaccttgtttaaatagctttaagacatataagaggcaaataattatatatacttaaggataaaattttcagatatttatccaaacacacatttacccattaaattagaacactaactgcttaatatgtaaaactagtttgaaatcatgactcttgattaaatacatacttcaacatctctcatg

SEQ ID NO: 2309 - DNA, 504 bp, Homo sapiens
  ref <308>: DATABASE ACCESSION NUMBER: Contig43679
  ref <309>: DATABASE ENTRY DATE: 2001-06-18
caaattcataggatgtctttttattatgctaataatttaatcacattccatggggtccacaataaactctttatattgaattccattccataataaaaaaaaaaaagaacaaaaaaacaaaaacaaagcaaggagctctatttttgggaaaacaatgggtgctcactgcttaactggattgtattttatttggcttttcaacacggcaatacaaacatattatgaaatgagtgaaaagggcataataattttattctaggtttctactaccttcatgattaagacttaactagctactgctgcttggccataatccactacagtccctaaacaaaaaaactatgaacaaagacaaaaataatctgtaatttctcctacaaaggttaacccaaattaacttacagcagaggtgaacaaactactgcctgtgtgccaacataacccagcttgtttttattagtaaggttttacatattatctatgattgttttcacactacattgg

SEQ ID NO: 2310 - DNA, 695 bp, Homo sapiens
  ref <308>: DATABASE ACCESSION NUMBER: Contig43694
  ref <309>: DATABASE ENTRY DATE: 2001-06-18
agtgtgacacttttagtgcacactcaaagacttgtgttttcacatgtatagaagttcatctgggggtttccaaagccttccgtattttcacttatgtgtggccttacaaaatgtagtttttaaaaaatctatggtttactaaatgtaacacgttaaaaatcactgaaaaatttgccaatgtaaatcctaaatttgggtttactaagttaaaatgaagcgttaagaccaaaaaaacattgaaaattttattttcacaggggatttgcataaaaagaacattatttttgttctgtgtatatataagtatttttgtttccttaacttgtttctgttgcccacacacaactaggagaagatgcttttctttattttggtttggccaaagatgctaatggttaaattatgaaggactttgttttacttatgttaagtggtgaaaactgtagttcttaatctatgaagaattctctaggtggctatacaagaaaaatacaaaaagttaggaaaacatgtaaacgtaagttatgaggtatttcatagatacagtgcccatacaaattctctttcccacaattttcaactgccagatctcttgctttagtcttttttccttatatttggagaaacagaagagtttgacataaaagtccctttgaggatgtgagggttgcagtagtttacagcagggtcagaaa

SEQ ID NO: 2311 - DNA, 431 bp, Homo sapiens
  ref <308>: DATABASE ACCESSION NUMBER: Contig43747
  ref <309>: DATABASE ENTRY DATE: 2001-06-18
gaaagtataaaaatcattttactttaatacaaaatcacataaagaaaggcatgttggctaaatcaaatattcactaaatatcagtgaagtcaccactggaatctcaatagcacattttcctgctttcttttctcccttctgctaaccattgaagaccagggtcatccgtgggagcagatgagtaggacacgcgtctgcacgctggaggccctgggggttgacatgggagcaggaagtggacccccccaccctgcacatcccttctgtttttcttgatttcagtctcactggcccaggccaaatcttcaagggtgtctagttctgcagccagggagaaagtgatgccaagagaacctcgtctcctccctcctcagtctgctttgaaggggaaataaatacacaggcctagtgtgtctgtgtggcacagggag

SEQ ID NO: 2312 - DNA, 447 bp, Homo sapiens
  ref <308>: DATABASE ACCESSION NUMBER: Contig43918
  ref <309>: DATABASE ENTRY DATE: 2001-06-18
aataccattttgagagtaattttaaagactaatgcgaaagttcgggagcacattgtatatttgaaataagtgtagtgtgtgcaaagaccattttctacctgtggataaaaatcaattcccccaaaggcctaaaagcatgaacaatgtttattttgagtaaataattaaactacatatttaacatggaaaaaattaaatgaatgtcaaacccaaaattaagaactataagcaaagcatgcagtctctgttaacaaaacttagttgtgaaactacatttttcattttgtaaatgccattatttcatttcataaaatgtaaaaatcctcagtatcattctttacacttgatgcggcaaacacttctttcctattttcctcgtatttcctgcaaaataaatctacatctcaagttccttatagttcatactttcttctcaacatatttgag

SEQ ID NO: 2313 - DNA, 399 bp, Homo sapiens
  ref <308>: DATABASE ACCESSION NUMBER: Contig43983
  ref <309>: DATABASE ENTRY DATE: 2001-06-18
gaatcacgaagcctcagtttactcatcacaaaaatgtatctaacaacagatgtctcagttacttcacaggatttgttgtgaggtccaaaggaaggaacagatgcagaaaacactttaggaggtgggaaaagcttcacaaggttgttctcatgaatcagaaagttgaaaagacctgccatgggtcctccctgggtggaggtcagactagaggacattggcagtagtccccttcttaagctgttttgatgacacaaagaaaaggctgagattctgaactatttttttttaacataaatgccacttaactagggaccagctctgtgcctgtgccaaaccaattggtgtgagcttgaggaggagtgaaggatggggacagagcatacacattgatgacaaaga

SEQ ID NO: 2314 - DNA, 685 bp, Homo sapiens
  ref <308>: DATABASE ACCESSION NUMBER: Contig44040
  ref <309>: DATABASE ENTRY DATE: 2001-06-18
atagtcaaagtggcagcagctcatttatttagccaaaaatagatactttctcgtacaatttggttcacacatatgtacatttctctgtatatatacacacacacaaaggcagacacgtttattctcactgaaactccaccccccaaaatcaaccggacaaacaaacctcacagcgaatgcggggtgccacagaagcgacttggggagggctgaggaggactggttttatttctttttcttactttctttgtttagttttgcttttaggtatttatacacggacatgcttacaagttgtaactatacagagcgattttttttatacaattattacaacgattaaaaaaagttttttttgtttttttgttttttttaaagaactaggatgaggagagagccgataagaccagggcggcgtccagatggttctggggccgcctgggcacgggctggaaagctgtcttgagtaactttttctccacttccaaggcactacagcgatctgttccgccttcgggctccgctggccgagcgaaggcggcggcggcagccgggtggcccgcggctccgggaagtcccagcaggtgcggaggggcagagcccagcagggagagcgggtgcgggcgggggccgggcggtgggcctggaaacggccggttggtccaagccgggaacttgcccagcg

SEQ ID NO: 2315 - DNA, 779 bp, Homo sapiens
  ref <308>: DATABASE ACCESSION NUMBER: Contig44064
  ref <309>: DATABASE ENTRY DATE: 2001-06-18
acataattacatctttctttaattatcaaagaatcactttagaacattagagttcttccagatcactgaataggaatttcaaccattacattccagtacttagagaaaatgtaaatataattgcctttagtcaaacaaaacaaaaataatatatttggatgatgaacaagtcacccagaaagggctgaaaattagcatgacagggagagaaaacatttctgggttggcgacgttgaaacactggctgtgcattagtccaggtgtgggaattccagcctcgtcctatgttgctgggattctgtttagtctcaggcaaggacttgccttccaggccttagttccttcttctgtaaaatggacacacttgcctgtttcagaggactgaggtgatgattaagacccgtgcacctgctttggtatgcaccgcattagacagtgggctcacacttgattaggatcggaatcacctggaggacttgttaaacacagattgatgggccctactcccagagagtccgattaagttgatctggggtggagcccaagaatttgcatttccaacaatttcccaggtgctactggtgctgctgcctggagcccacctttcgagagcccctggtctgcaccataccaggctgttggataactctgtctggggtggattagacaaaattctgcgggcaggaggttttcctggccactgtcagaatacctcctctagaacttccgatttcaaagcaaacaagtttgttcagcatggacccttctttttgttgttc

SEQ ID NO: 2316 - DNA, 646 bp, Homo sapiens
  ref <308>: DATABASE ACCESSION NUMBER: Contig44195
  ref <309>: DATABASE ENTRY DATE: 2001-06-18
aacataggatttttaatgtggaaatgtaaggaacatttacatccccagtaatgaaagagactcaagagtagaggcttcttagaagtcaatgagagaagaatccggacaagaaacagcttaatcctttctacggcagagaaacatatgctcagaattctttggtttcattttcatgtaataatttcagttcagaatatagtttatgttctaaaaaagtcttatttgcatttttagtgaggtgctttgatcatcttcaagaagactgctgggaaacatcagattcctggaaccataccacaaaggatccgagactttcacagggaggttctgcaggcaggaagtgtgctgggatgccacacaagcaaacagccctgaggagctctgtggctccattttcagctgcagggagaacaggcacagtcagttctcagatgtgctgctggtgggcagggcccactcacctgcaactttcagtgtcaccatctcactgcgctgggcctccagaccattgtctgcctcacaggagtagattccagaatgttctgtagtcagagagaggttgaaggaggcccctcctccagagggggctgagatcttacccagggtgacatcttcatgataaaaccagtacaggattggggaggag

SEQ ID NO: 2317 - DNA, 449 bp, Homo sapiens
  ref <308>: DATABASE ACCESSION NUMBER: Contig44226
  ref <309>: DATABASE ENTRY DATE: 2001-06-18
cataaaaatgtaagttttattgagtgcctatagtgtgcatgggcctttattagacacgccaaattcaggcacaacagacacaagatccctggcctcaggtaccttatgatctaattaatagatattagaaacagtagaaagacaagttacacgtcaatgcccaatgactagagtcaacattaaagagttgtaatttaagtaatccaaactgacatctaattccaaaatcatttataaaatgtatttggctttggaatccacaggacttcaaacaagcaaagtttcactgcagatagtcacaaagatgcagatacactgaaatacttaagagccttattaatgatttttgttattttggatcttctgtttttttcttattatggtccgaagcctccttaataccaatttatcagacagaagcatgtcatcttgttgttcaagataatcca

SEQ ID NO: 2318 - DNA, 452 bp, Homo sapiens
  ref <308>: DATABASE ACCESSION NUMBER: Contig44265
  ref <309>: DATABASE ENTRY DATE: 2001-06-18
gcataaagtaacttatctaggtctttaaatggctaggaagttaggaagttcaaatggctaagttctatttgaagttggggtaataaaataagcatcgaaattcagaacattctcaacaatcacttaggacagcagttactgaagcaattcttaatagtgctgtgaaaaggcagcaagaagtctcagataaggaatcatgctagatcataaatatttcagcaaattatgatgacatctaaaacacaaactagtcaagagaggcaaagcaggctttttgattagtaagtgaaaaatgaaacaagatgcatatcacaatacagtcactagtagacagctgaaattgatcacagtaacgtgcactttgtcactagatacaagtgggataaaagtcgatcccaaagcatgcggtacaaaatgtgcaacatccagctttgtgcagggggtcctctata

SEQ ID NO: 2319 - DNA, 477 bp, Homo sapiens
  ref <308>: DATABASE ACCESSION NUMBER: Contig44278
  ref <309>: DATABASE ENTRY DATE: 2001-06-18
cttctcttggttttattgtttggtagaaaaacaggctctttaacactgaataaacatctcacgaactgtcgctcctagattacaaaaagtcaaaaccaatttcctttgacgccgggcccttgaatctgacattcaagtcaccgtaatagaaaccagagctgctgaaccttacattctggaaggtgcttgaacaaaggcatgttaaggaccgtttaaaacttctagcatgtaagaagatccatctttccttccaacgcctttggataataacagcagaatcccggagatctgctgctgagtttgagaaggccaagtttaaggattccaaactccagccttcaatatttctgcagaaacttagagaagtaacctccccgtcctctccgctggcttccccaagtacagatgcaggatgcaggtctttcttcctgctacccaggcaccgaggactcaaaccatctcaccgtctcatcactg

SEQ ID NO: 2320 - DNA, 478 bp, Homo sapiens
  ref <308>: DATABASE ACCESSION NUMBER: Contig44289
  ref <309>: DATABASE ENTRY DATE: 2001-06-18
aaattaaaataaatttttattcaaagcatcttttaaaattacagcatgtttattcttatgctgttaactctgccaaactacaacttagccatatgaagcataaaacacttcaaaaatttgaatgtaaaccattttttaaaacaaaaagcagtcttaacacacctcaaattttagataccaatgtatttttccaagtatatagcttatatcaaaaagaacattttaaatgtttctaaatagttgtgataatttcttaaactgttgcaattatacaaataaaaaatgtttatgaaaaaactattagagttgacaaaagctgactggagaaacaaggaaaaacccttacttttgaaggccttaaatgttatcatctgtgaattggcaaatatttgtatttgaaaaattcttactacccttccttctttagttaagttgatcaaagttcaaatttcccaagactgatgagtgttgtttttag

SEQ ID NO: 2321 - DNA, 546 bp, Homo sapiens
  ref <308>: DATABASE ACCESSION NUMBER: Contig44310
  ref <309>: DATABASE ENTRY DATE: 2001-06-18
acagaaggagttcaaaatttatttataaatttgtgtaaaagaatataagacctttttcttttgtacatatttgtaccataaagaaagtagggattaaaatctaaaaagacccccaaagctttcaaaacctgatctgagaattagataagaatatgtcacttagaaagacaagcctgtagcacccatagctctgattaacctgaaagcatcaagtgactccctctttttctaccctaccaacatcactctaattatacttccaattagaaaaataatgtagcatttccctggcagtagagtttaaatatgagttcaggaatcagctcctccaaacatgcataaatgaggacaaggagaagccagtcactcctgactgcacggtcaagtgtgtgggcagttgaaattaaggtaaaaacagtgaggctgaacaaaatcacattaagaaaaagcatctcatgaggcttttcgaggtcagttgatgaaggccagataggagtcaatattttctcatataccccagctgttaccactattctattccaacag

SEQ ID NO: 2322 - DNA, 567 bp, Homo sapiens
  ref <308>: DATABASE ACCESSION NUMBER: Contig44409
  ref <309>: DATABASE ENTRY DATE: 2001-06-18
gcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggagg

SEQ ID NO: 2323 - DNA, 543 bp, Homo sapiens
  ref <308>: DATABASE ACCESSION NUMBER: Contig44413
  ref <309>: DATABASE ENTRY DATE: 2001-06-18
gcatctgttctgtgcatattttattgaataaataaaaattttattggtttggtttttaaaacctataaacaatattcttagtttgatcacttaaaacatacaactttatgtaaccaaaatgcttaaaggattttgttcactgagtgttggctatttatacctatacatatgaaaatctgacctgtcaaaactggttttgcagtagccagatttgagatatatgtggatttctaaaaggttaacttgtcaaattatgagatctaatacaacacccaggtattaagggaaaaaatgattttgcaaccccaagttgggacttaacataagaaatccttatggtgttgccaacgttaaaaattctattgagcactttcatttttcagaataaaacaggataagcaaataactcacaacagtacctcatagtcttctataaatagctaagctatactttacagctataagaacgtgatatttgtatttccctgagagcgtagtttgctttgagttcaagggcatggtgtatgtgtatatgtgtgtttc

SEQ ID NO: 2324 - DNA, 732 bp, Homo sapiens
  ref <308>: DATABASE ACCESSION NUMBER: Contig44451
  ref <309>: DATABASE ENTRY DATE: 2001-06-18
atctgtaagaaaatgtttattcttttgaaccccacaggaaaaaaaaaaaagaatgcagccaagaccagtatttaacgaagtgtcccaaaaggcagcaaaatgggggaaacctcaaaacaaagtcagtgacaattttccatgtttttgcacaaagaagagaaaatctatgacaattctgagtaacactttcatggtgacaattacacaagatgattcaaaaatgcaaaatggcagcaacatgcacacctggctaaagctagaagtattttttttaatctcaaaataagatctgtgatttaaaggatgattctttttaatacttctattttactgacttgcttgtcctacttaatttgctttaaatgagacgtacatgccaattaacaggaaattttagaagaactatgtccttccagaatccatggcaaggaagcaaaaccaatttatttggtttcttaatttttcctagtttccaaatacaattttgcattgcccccacccggtccctcccgccacccccaccctgattcttaaacacttccaaaagttgcctgtgcaaacacttttctacccatgtataatacacatttgaaactgaaatctttgtgcagagttttgagtttaagagtctttaaaaaaaaaaaccctccttggcacaagagctgaggaatagtcaagcttcttttaaatcatcaaacacaaaatgatgaaaagtggagaaagcacagttaa

SEQ ID NO: 2325 - DNA, 630 bp, Homo sapiens
  ref <308>: DATABASE ACCESSION NUMBER: Contig44585
  ref <309>: DATABASE ENTRY DATE: 2001-06-18
gcaactttttaaaacctgactcttcttaggaagtgctctctttgtacactttgtttcttgagacttcctcctattaattttcttttctttacaaggctgaacttctgtattcaataagttgcaaacactctcttctacaacactgaccaattgatttcttctgttagaagtccttgttattctaccaactttaggagaggatattttctcatggttatttgaagaactaaaggtatcagtgcctgaaagggtctcagagattgatgatttattaggagaactgagaacggcaaatgatacttgaagtggttctatgttttcaagattctcccccttgtcatcaaaatctggttgaggtaatggctcaggaacaggtgactgctcaagcagcagggaactgagaccactgaagtcttttttacaaacaggtgttcctcctttacgcaatggagtatttgctggcaaagattcatcaaacacttccgggcttaagtcctctccaaaagtaactctcttcctcttcctcatatttagaaaggcaggtgcttcaaaattttcttcatcttctgcttctttctctttgcaacagtttgggagatttgagattaagctcggatgagtcccatcatc

SEQ ID NO: 2326 - DNA, 428 bp, Homo sapiens
  ref <308>: DATABASE ACCESSION NUMBER: Contig44656
  ref <309>: DATABASE ENTRY DATE: 2001-06-18
gcaacatacaaaaactttaattatttttgcaaaaagaaagccaactattcgccttggaaataataatgaagtacaaatagctctgactctgcatttggacaaggatgaaccatgatagatatttagaaagggttttaaatcatgtgtatgttggctacagagtaaaaggaacagagaagactcaagctattgtcaggtgtgtatgtgtcatcagcacacactgggggaggagagtcctcactaagtgccacaacccctgatagctgtcagtctctcatgaagcaccatgatctggcatggactcccaaatgccacttgagagaaggtcttcacagcagactgtgcatctgtgtcacaaaacacggctgcaatgaacgacagtgttcattttttgcccttccaaatgtattcttgtgtatgatcgaagc

SEQ ID NO: 2327 - DNA, 687 bp, Homo sapiens
  ref <308>: DATABASE ACCESSION NUMBER: Contig44703
  ref <309>: DATABASE ENTRY DATE: 2001-06-18
ttaaagagatgaatttattggtaaatagataaaattaacacctattttaatatatccaaaccccttccttatatatattaggtaaattaaaagaaaaaaattatcaaagcaatactacagccagctacatcgccaatttacaaatgagttagtaagtaccataagtttgtttgaatatcaggtgcttcagagtttttctcaaacagttacaaaagagattaggttcccaatcagttcacaaaagctaatttaaagaatgtagcttaactacagtactgaggttgtcacacacttaactttcggtctcttgcttatttattcatatctgaggttcactgtttctactaggatacattccgcccacacccacaccttggtccccacatcaagcagctcctcacagcaggaagacatccgctatcagacatggttttctgaagttgtgcttaggatttcagaggaggaaaaattcagaggttctaatagccttcggtaactgaggtagaatatggggctcccaagaatatcttccatatgccccaaatctgtttccctcccaccaaaatccagctctgttcaaggtcaagtttgagaaagatacgtgttctcaatggtatatttttaaaatccacatcaatttttaagagactacctgctaaaggagaataatggctcactgcatctttt

SEQ ID NO: 2328 - DNA, 447 bp, Homo sapiens
  ref <308>: DATABASE ACCESSION NUMBER: Contig44708
  ref <309>: DATABASE ENTRY DATE: 2001-06-18
gtcttacattttttcttacaacaatcttttgagaaaagaatagagaatgtttaccaggtagaaaaaacctgattccttaacaagacttctcagtcacttgtttctctttccctttcacttttcctttgtgcttttgaaaacaaaggctaaagcaggtgttataaatttattcattcctgtgctagagagcatggaacacatctctgaagtcaactcttcttttggtgtatcacgagttgaatccttaataaatgactgccacaaagaaaatttctaacagcaaatctttttaggaactgctcaggttttgccttcgtcttgacacttcattttaaaatcttggtttctactgatgtgttttcaaaaaagctgacaaactcggtctgaaatgtagacactgaaaaaagtgaaaggaagagaacatgcaatataagttaatcattatca

SEQ ID NO: 2329 - DNA, 449 bp, Homo sapiens
  ref <308>: DATABASE ACCESSION NUMBER: Contig44757
  ref <309>: DATABASE ENTRY DATE: 2001-06-18
agcatatccaaaaatggtattgctttattttttaaaaatatatttcttttttgaaatatcaatcgaatcaattttattctcacaacaatcctgagtaaatatttttaaaaaatatattttttgaggaaacagattaaaagctttaaaaaatgtgattcactgaaaatcaaatagtgaatacatgatagagtcagcactaaaaaggcagatatatcaaagagagactgaaataagcaactcattttttgcatcgacttcgaaacacctctttaccatcagtgtttgtaataatcattcttgatctttatacttcacatttcttggtaatccaaatgcttcataaattctcttacacatcctgaatctcttgcttcattcagcgagataattcctggtgagcaggaatgcatatggttttcagatgtagaaactgggatctccagagacaa

SEQ ID NO: 2330 - DNA, 748 bp, Homo sapiens
  ref <308>: DATABASE ACCESSION NUMBER: Contig44799
  ref <309>: DATABASE ENTRY DATE: 2001-06-18
gctgcactgcttagaatttccagtacaaggttaaagagtaacgggttaaattttgctattattatagcaaaaatgtcatgtttgtgatattaataaacatcagctaagttttcattgatacacctgctagactaacactaaaaagtaattgcaaattagatatttaaggatctataaatatcttttataagtagaatgtattaactagaataaatttgttaggtatgctcattatgtcaatttcatgtataaatttctcttcctttctaggtgattgacatatccttttgtcataaaatcaaatttcaaatgccaagacctattatttcaatgtagcattaaaagctagcaatcactgaagggaagccaagttcccaaaagtttacttgtagctgacaaaaagaacagacagttctgaagtggaaaatgatgtcccgagagaacacagagtaccaacggagtatctgatttctcagggccttcccaggacaagggagctgccactgccaagtgctccctagcggcccagcaagcgagcttgcaggtgatgggacctgcagtgacactgccatgtggataatcaggtgtcttgtctgtattcttttatcacaaattattgttcgttacttcaagaaagaaacaagaaataaaataggaaaaaagccagagacaagtcttttttttttgccctgctcctcaaaaacgagaatgagaatttattctaacacatcatcttttcagcagacag

SEQ ID NO: 2331 - DNA, 500 bp, Homo sapiens
  ref <308>: DATABASE ACCESSION NUMBER: Contig44829
  ref <309>: DATABASE ENTRY DATE: 2001-06-18
cataactctggtcactattttcatccgcatctgtcacttctgatgcgtctctaacatttataagatttctctggggagggatttgacgtatccatgccccacctctttctacatttatgggattgagctctccaccagccacccatgggctgatgtctttggaatatggatctagtaccaacagagtcagaaaaagagatggggtccaatgggctacagttgggtggtggtcctgggatacacagcacagtggcctctactgggggatggcagctttccaggagaagagtcgcaagcttgcctgtgggacttgtgtcttgtggagaggacagggctgcctcagcttggggagacagacagagtgttccgggtcccctctttccgccgcagcatgaagtctctgggggcgactggactcatggcatagaagacgttggcattgtcaggaatcaggagcacccggtccccaggaaggacttgaaagagctgatagtcacagg

SEQ ID NO: 2332 - DNA, 753 bp, Homo sapiens
  ref <308>: DATABASE ACCESSION NUMBER: Contig44870
  ref <309>: DATABASE ENTRY DATE: 2001-06-18
gccaacacgtctggcttatttttttgtatttttagtagagatggagtttcaccatgttggtcaggtgggtctcaaactcctgacctcaagtgatccgcccatctcctcccaaagtgctggattgcaggcatgagcgcctagccaggaagctatcttttcttgagttatgaaactttgcaacagttgttcaaattggtgtttgtccttcctatagctttcatattttcaaattaattctgtatggctatataatttatgttttaaaaggcaattctcttgactttggaaatatggaagtctctcctttaacctattcttgttcccattcccagtctcatttgaaatcattccttttattgttagtgtgtgtatttttgttggtgtgcttttaatgcatccaagtatgcatcattttggataaaaaatacatccaaattaagatgttttaacacataggacaaacttgtgcactttttatgccaaaaaaaaaaaaaattgggttttccttcatgggatttctagaaacactgcctacactttatgaaaactacatagtattcacctgtgacaggtagagtttatcactattaattttatgaggctatttattactttccaatgcatccacttagaacaagctaagagtaaggctgctaactttaattccttgcctgattttattgtacagtgtgcacaagcacaatggtatgcttgtatatagaaactaaaaatactatgaagtacataagttcc

SEQ ID NO: 2333 - DNA, 565 bp, Homo sapiens
  ref <308>: DATABASE ACCESSION NUMBER: Contig44893
  ref <309>: DATABASE ENTRY DATE: 2001-06-18
tatttccatgaattcaaagccttttaatgatgtgaacacttactccccatttcttttttacattgttacaaaaaatttacatacagttttctgaaagtggcattttgttggttgttattatactgatgacacatattaacactttgtattgaagaagtatcataaaaatcacagggcattacagatttttgataagaagtagtaatagcattgtcttttaacagctggaggctcccaggcatactctttggtgagaaatgattaattttatattttcattttgatgagaatcttttcttgtttttaccagttataaaaacaaagctttttctttgttgtgatactgtgcactaagacttagtttcttgagctgatgctaaataaaatgagatcaataggaatattccaggaggtcgtgagaagtttttagaaaggatggcatctacatatatatggagctctgaaaactgttggagagtatgacctgggactgaaactgtggagcacatagccagtgtcacaggctccgagagcagagagagtttgctctgggacctggaatgag

SEQ ID NO: 2334 - DNA, 556 bp, Homo sapiens
  ref <308>: DATABASE ACCESSION NUMBER: Contig44909
  ref <309>: DATABASE ENTRY DATE: 2001-06-18
aagattgcaaaacactttatttccatcacatatgtgccaagacttgtgttctgtatccaggagtgtgttagatactaacatagtgtttcatttacatgtgtgtgaaacctgggtgaagagccagggtttctctcccccacccgcctcagagtgcttgtcctggaatcagagtgtaaaaccccctcttgaagcagacaccaaaactgaacttccacccggtcatgggccctgctcttcctgctgtcagcctagtccaaagagcaatgagggaactgcttaggaggggtctgagggtgatgagggcctgggggccacacaggggtgggtgctgtcaggtacaagcccatccctgcctgcaaataaccttgcacagggtccttcctcattctttcctcttcctttttgtttatgagatgaatggctcttctgctgtggctttaggggcagtggggaggcagggagctatttgggaacagcctggaaagctgaccctgcagaatctcccagaagccttggtgtggctatgggtacccaggctgtagaaatcccagatggt

SEQ ID NO: 2335 - DNA, 538 bp, Homo sapiens
  ref <308>: DATABASE ACCESSION NUMBER: Contig44939
  ref <309>: DATABASE ENTRY DATE: 2001-06-18
tcataaaaaggagaaggtaagattaccagaggttgtcatgactatgccagtaacagatctatcccagaattataccacttaaagcagactgttagaagccccctcagtgcagtgggcagcacgtcagtctcataatctcaaggtcctgagttaaagcagactgtataggaagatctatagaaacccgttactactaaaggggaaaaaaaaatactgtacttaaaaaaattagaagccagtttaccattagagagagttttgatttgagatataaagaacatattcctctccaaaactgagtttcctctgatacaaaagtatttgccttctggagaagatatggtttgcaccgtccaacaggtgtgctctgaaggcccccactgaaatatattgcatcatagatgaggggaaagacttggttaatttctcttatcaaaagctagtcttcaggacatcctgtccaacttggctcccaggggcccaagggttcttctcagagattgttcttagagacccccaaacctgcagcccaagccca

SEQ ID NO: 2336 - DNA, 375 bp, Homo sapiens
  ref <308>: DATABASE ACCESSION NUMBER: Contig45022
  ref <309>: DATABASE ENTRY DATE: 2001-06-18
ttcaaggagagtcattttattatgaatcattgtgcaaagaacataaactaaattgtaagctcttctagggcaacacccaaatatcctaattttgaattctgtacttcaaagtgattataaaggaataagactttttataaaacaaacgtatcatatagctcatatatgcaaaggagttttatcctttcaaataagtccctgtatcgcttaaaacatttttggaagttctatctaaaattttgtttcatgtgaggcaggtgtcagcaccgaaaaggtactaggtccacttcacactattccacctggttagaccatactcatgatggccagtcagttatgggaccgtaaacaaaatgatactggactagcttagaa

SEQ ID NO: 2337 - DNA, 710 bp, Homo sapiens
  ref <308>: DATABASE ACCESSION NUMBER: Contig45032
  ref <309>: DATABASE ENTRY DATE: 2001-06-18
taattttattgatgcttcagttttcataaagtgcaataaacaaaataaatagatgaaaaaagctttgaagatttatatacagttttgaggttaagataaattactgactatattcctttcagccttttaactctgtgaaagctgtaacgtacattaaaagcacattgaactaggttaaataatgatctttcccccttagatcaatctagtattaaggagtatataattatgcaagttcattctataacacgaggctagactaaaaggaaaatttttgtgctacagactaaatccagatacggtcaggtgctgagcagtattcctggcttcaaaataggaggtatctgtttcatcatctggctgggggatgaaaggcatagtctgatgctgcagattttcccagtccacatcactgaagagaggatgacgttttagctcttaggaaaaatataaaacaaaacagtatgatatcattacctaagtaagtactgctttacaggaattattataaaaagagaatgtctcacatataacttaccttactttattatgtcagtttcacagacatttgtttaatgtctgttaggccacatacttcacaaaggtctacatgggccattttgaatatcacttggcatatgacaggtgcctggtttgtatttgtttaatgacagaatgaatgatttgccttaacttagaagcctatcttt

SEQ ID NO: 2338 - DNA, 501 bp, Homo sapiens
  ref <308>: DATABASE ACCESSION NUMBER: Contig45041
  ref <309>: DATABASE ENTRY DATE: 2001-06-18
caaggtgagcctgatcacagcctcggtagtatttattttgaaataaaagttcccatcccttgtaggcctcgctgtgaggcacaacgtcttcgaggggaagttgaagtggggtcttcttattcactggtccctagaccgcaccttctggtatcttctaaggcaattctggtaccgcactgtgtctgggttggcctatttaaatgtctgagccagctgttccaggatttcaatgagtttctcctcttcggccggtgaggaggacgctgtagcgagaggcaagtgtgtagaaactggcttccgatctaaaagtgagagggaaccgcagagaggtgtgagctgctgcagcgtggctgggtccatgtccctgtgctgctcaggccttgaaccgacgcctgctggagtggcagcaccctacagctgttagacccccatccctgctgtcaaaggtcccacagggatcaggcagcatggattgatatgtaaagtgcagtttgggaactg

SEQ ID NO: 2339 - DNA, 475 bp, Homo sapiens
  ref <308>: DATABASE ACCESSION NUMBER: Contig45049
  ref <309>: DATABASE ENTRY DATE: 2001-06-18
ccatctcattattttaatcattttgtcaaaaaatctgaacatgtgtacataaatacttgatttgttaaaagaatgtgtagcatagaaatccctgagacacattcaaaaatgacttgacatcttgacatgtattcaatgcaagtattcaccaaactaaataccaaggacttggctcctttccctgatatttgaggcatataaagctttaaaaatatatataatatactatatatataatttacatctttaaagttaaattatattttctttctctgattcctggttttctgccagtttactgctcctgcatattgtcagttccagactgtaaggaagccacattggaaagcagataagcactttcaaccttagggtgccagttagtagaatgatagcacgtggaactaggaggtcccaacagatgattttgtctaacccactcattttgcagttcaggtgacagaggctcaaagag

SEQ ID NO: 2340 - DNA, 560 bp, Homo sapiens
  ref <308>: DATABASE ACCESSION NUMBER: Contig45090
  ref <309>: DATABASE ENTRY DATE: 2001-06-18
cctgagacacaaaaccatttatttttggttcatttcagtatctatagcagtgcacaaataacacatttccatccacatgaatagttcccaattgttggagcaaattaatcttttacaagctactgagcagtgaggttagaagataaacagtagatgaaatcgtacactttcccctgtatgtgaactttcttattacaataaactcctacatttgagctcaccacatccaatgactgcccctctctgttcatgtggcggccccggctgccccctgccacctctgccctgctgaggtagttctctgatcagccacctgggtggggcatgctgccattttcagtttggaaggaaaagcctgtaaatctgcttcctgggaagagagacactgctgaattgtcatttgcctccagaatgcagaaaacatcaatttcattgcagctcatcagggttggaaacacctgccacttcctttctcggttgcaattaacatggtgcatcttggcattgattgattccaagcagcctaacactgccaaagtcaaggtttaaatgaacagtac

SEQ ID NO: 2341 - DNA, 398 bp, Homo sapiens
  ref <308>: DATABASE ACCESSION NUMBER: Contig45156
  ref <309>: DATABASE ENTRY DATE: 2001-06-18
ttggagctgatgcctctctttattcatgtatttcatcccctgctgcctggtttctcctgaatccccttgttcccctaaatagcacccccagtccccgcccctagcccagctgcaggtggagtagcagctgctgtctccattcagcagatgggcagactgaagcccaagagtgtggagcccagtctgaggtcacacagcagtctcctgggttcccacttggccttcaatggggagggaggacttggcctgggctccgtgcgccctcactgcagggtggctggctgcggccacgtcgcagggagctgccaatctggtctctgagggcctccagtctctgggccaggtttggaaccccggccccacctctgagccctggtgatgtcttcgggggcctcaca

SEQ ID NO: 2342 - DNA, 843 bp, Homo sapiens
  ref <308>: DATABASE ACCESSION NUMBER: Contig45316
  ref <309>: DATABASE ENTRY DATE: 2001-06-18
cagtttacctacagttgcagtaccaatcctttcttgaggagttttaaatgcatggttgagcaattaaattgtatgaggatgtgacatggattagacaatgtcggtagtaccaaactatttcttggctgctccaacatgcggagatgacactgcttttagctcatgacagcccaaggggaatgttttactgactatggacttatagcttggtggaaattaacataggacgttaattagcaaaagtatccaaacagaagagtgaatgaaaatttaaaaataaaacaataatggtgtataaatctattcctgaatgtttttcctgactacctttctaaagcaacaccttccatgtgctttcactaacacagcctcctttcctatgtgactggatccgcttcttcagggccatcagtgcatcagtgagaatagctactggcaaacacgttactcagaggtgttctgagaacggtgctgtgaaaaggacttgtcacttttgagctattgagctcccccatttctgagacctgtcattttgttaagacatgattgaggctgagctccagataagatatattctttacggtacacacatacttattagattcaagcacgtttcttagtggcaggcagtaatgactcaattggaaacaaacaaaagggttctaagttgttttctgattacaggcactaccccgaagcttcatagacatatacattttataattcattcattagatgtgaggggataggtccccagccataacttcagagcattccagagaacagagtttgccgcttcaaaaatacaaagtttccagcatgcagtcaagcactttgacaagg

SEQ ID NO: 2343 - DNA, 978 bp, Homo sapiens
  ref <308>: DATABASE ACCESSION NUMBER: Contig45321
  ref <309>: DATABASE ENTRY DATE: 2001-06-18
gaagtgggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcatcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaaacccacacacaaacaaacccatacgatctgtatttgtatatacacgtgtccgtacaagtataactaaataaaaattaaagattttcatc

SEQ ID NO: 2344 - DNA, 406 bp, Homo sapiens
  ref <308>: DATABASE ACCESSION NUMBER: Contig45347
  ref <309>: DATABASE ENTRY DATE: 2001-06-18
aggctgtggaggactttattcattagacccagagagccatgagtgcctcccacgaagtccccactgcagggagccagggtcctagatgccaggccaatgcatgtgccgtgagctggccgaggggtctgctggtcccaagagcgcctctgtgttcttcagacagctccgggtatggtggcctcgccaggtggcttgaactatcttcgctgccatttgctgctgcctcatctgctggcggatcttaaagcccctccaggcggactggatggctgtggccgctttgtcctggcgatgcggctgcctgggactcagggcagccagctggtaggcggaggcccaagacactgccccggggccctcagtgccctggcccatgccctgcaccacacgggtgggctgtgtgcgt

SEQ ID NO: 2345 - DNA, 420 bp, Homo sapiens
  ref <308>: DATABASE ACCESSION NUMBER: Contig45375
  ref <309>: DATABASE ENTRY DATE: 2001-06-18
gcgctgagctgcttatttattgaaaataaacgacggaaaagtctggccttgcctctgtgcaagcttggaggcctgggtcgccgctgtggacaagcgtcttagtgtcatgcagaccagaaggcagctgcctgtcccagggccggggcccacctcactgcctctgatggggactcccagcccccatggctccgctgtgccctgggcaggggacgggctgggggcaggggagggctggagcccaggaggcagcacagcagccagaaagccgcaggcctgagcctgcacctttggttccgggaggggcttgggcccctcacccaggtgtgatccctgagaacaggaggcccagccaccctgggaggaggcgctggagggcggggcggtggtggcccccgtcagtcccctcaaccccagtctcag

SEQ ID NO: 2346 - DNA, 655 bp, Homo sapiens
  ref <308>: DATABASE ACCESSION NUMBER: Contig45443
  ref <309>: DATABASE ENTRY DATE: 2001-06-18
ctcagataatttaatcagaattttaatataaacaggtcattatcccatattttacatgcagaacgatttcaatattccaaaaaaaaaggcgtcttctgtacatggtgctacttggctcttgtaggaaaacattgaaaaaataataattgagctgttggggggttttgtgtttctgagttgttttctgcaaaagctgcagcacatttgatcctgcgttgccaacgcacagggccgaggccacccaggcacacaaagggacgaggagaagcaactttcaggcaaagtgtaaagactaaacaagctgttcctgaatatgtgcatggatgcacacttattttgaggctcttccttccttctccaatgggaccaagagccacagatttgtgatctggtttttaacaaggattttcagtggcccgcacccagatagaaatttggctggtggctggttctggaccttgactagtatcagaaggtaaaagtaagctcaaaaagccattgtgtcccctcccctcactcccatttctcggggacccttaaggaaatattcaccttccattgcactccctgaaagtccaccatgttcttttgtatgttctaggaaaaaaaaaagtgctgacctgttcttttcattcccaacctcacctcgcatata

SEQ ID NO: 2347 - DNA, 596 bp, Homo sapiens
  ref <308>: DATABASE ACCESSION NUMBER: Contig45454
  ref <309>: DATABASE ENTRY DATE: 2001-06-18
aagaaaagagctctttattccacgtcgtccgatatttttacacaagtaaaataaaatgcatatctctatataccgcgatctgggtgggaggcggcgttctggaacaaacgctgccgccgaaccctgtaaacatgatggggtggagatgggggtggcgggcggcaggcgtccatcagggaggacctggcctggcctgccccacgggtcggccgcccggctggcttggcggcgtggagagagaccccgtatgtacacacacctggctgctgagcacgctcttgtgtccgctgggggtcagcagggcccaagcactgtccacagcaccagcgccaggcccaggggggtgaggctgcaggtgaggctgggtagggcacctgagccttctgagtcaccagtcccgccacccccgctgcctgcctggcccagacggcagtggctgcgggtgcggttcttgcgtgaacagcctgcgtccggcgagggcccgaggtggggaaccctggtggctcggagccctcgggccgcactgcagtgagcgggggctcagcagagccaggcagagtcccaaagggtgagtcattgatgtgccgtgggccaga

SEQ ID NO: 2348 - DNA, 762 bp, Homo sapiens
  ref <308>: DATABASE ACCESSION NUMBER: Contig45537
  ref <309>: DATABASE ENTRY DATE: 2001-06-18
cttattcagtctccgtagagactgtcaaaaattgccagcgctgattatatttcaagtcatcacggtggggtattgggaaaatttccaattagcaataatcgcgtctcggataaatctcattggctacggtactgccactgtgcaaagctagcttgacgtaggactttgatggtcatgtataacacctcacaggggcagaacctcctccatccccgactccaaagactcatgtaatcagtacgcaagaaagttcagagatgagacctctggttgtattccacctttgggacatgggggatgtctttagttcaaagtcacaaataaatgcaggttctacaattcagaggcttcatatccctgctggagtattacatgtttattcaggatggaccacttttcttagcaacagtttctaaacctttgccaggtctgggaagtctggcaggagagatttctaagaaccaatcattcctgcacacatttcttgaagataatatacattattccctagttatctcttcctaggtttttgtaggctcatttcaatattacaacaatctttattggaaaaccccaagtattttgtcttgaaaaatcagcaatccaggtattaaaaatagcatggaatgcccaattttactttgataattacatggtagtcagtttccgctcctggctaaagccttggattttcttctgggcagttcctaaaggcacaggtggcatggaagaaatcattccattttcgtctcctccccttat

SEQ ID NO: 2349 - DNA, 449 bp, Homo sapiens
  ref <308>: DATABASE ACCESSION NUMBER: Contig45588
  ref <309>: DATABASE ENTRY DATE: 2001-06-18
ttgcgtccacttcctttatttctcatcatttacaaaagatgtacagagagggcatgtgttgggcacggagcaggtacaaggggctcctccccacggggccagaaaaggggggaaagaggttagggggcaagaggtgggccccccagggagagtcctggagcccctggaggggaagaaattgtcctgtccccccattccgcctgctttactttgaaggtctcggaccccaagccagtgctttggagctgctcaggctgccggggtggtctggggagggcagccaccccccgtctcagggacccgcttcttggatctgctgctgttgctgctgtcgctgccattgccagctctgaacagcccctgggcaggtgcactgtggggtacgacctcggaccccgcctcagggatatgaggggtgctgagcggtcattggtgatggtgggacgaag

SEQ ID NO: 2350 - DNA, 932 bp, Homo sapiens
  ref <308>: DATABASE ACCESSION NUMBER: Contig45708
  ref <309>: DATABASE ENTRY DATE: 2001-06-18
ccggctcctccccggcgcacagctggattccggaatctaggccgggcgtcaagagcccgaccccgcctgggcccctcctgcccgccatttctccagtgcgcggctggagtccgaaggagacaccctcccccgcccctcaccatccggtggataaaaatagccgcgcgcaggccttgggaacggtaatgggagccacatgttggccagatgtgcctgggagggaccgtcaggaatgcggaggcccaggccctgcccccgcgcaggccccgcccccagcgaccagaccggcgtggcgccgtgctaggcagagtttactttctcgcgtttcccaaagtcgtgtgcaaggacgtgggtggccccagccaggtcaggccgcggtcccttcccaggcccaccctcagtaggtctgcgtctgcgtgtggatgacgcgcggggtctgggacttctgggtcccctgcatcacctggacctccagccgccggcgctgctccttctcgctcttcagctcctcccagatgtcggtcagcttcctctccagctgcacctccatcagctccagcgccctccttagagactccacctcgcccctcagcgacgttacatcaactccttcattcttgttttccgtgtagttttgcgggaccagcgaggggagcgcgagcgtctcttgggagtctggaggcggcttgataggacgtgttttttgggcaaaggctctttctatggggggcacctcctcttttggagccacttcctctttagggggcaattcctctttcagggtcacctcctctttggaagccactccctctttggggagcacctcctctctcagaggcctctgctcgttggggggcgcctcctcttcaggggtcctctcgtcattggaaggtgcctcctctggaagggttgtagcctcttcgtgggggtgg

SEQ ID NO: 2351 - DNA, 907 bp, Homo sapiens
  ref <308>: DATABASE ACCESSION NUMBER: Contig45816
  ref <309>: DATABASE ENTRY DATE: 2001-06-18
cagttctcagtcctctttttatttgaattctcagcaatattcacagaatcatcactctccttgaaatactttcttcctacttcactggcctcagtctcctttgctagattactctgcccctttccatcctctaaagttgggagaactccaggatttggtccttggtacactttgaatatattccctccctaagcagctcatccggttctgtggatttatatacacacggtacacagtgaaaggctggtatacatttcagagtcaatggcatacataacgctgactacagctttactttgaaaaacaaaactaagtatcttaacattttattttacattatatttaataaaaattatacttacaactacccagtaactcctagaacaaggacaaactcaaattttgttttggtgacagttttctgacaagattaatagagcacaatggacaggtcccccatttgactttcaaggaacaatcataaaacagggtaatctttactgcatcaaattcccaaaactacgcctttgaagtaagttgacataatacttgttgtttcttctcaaatttttaatggttctccacggtatgctaggtccttattttctcattggctgtaatttgacaagttctccaaaagcactatcatgaacttaattagataatactttccagctgtacttaaatcagaaggatcgtaggcctgataagcaggtcaacctgaagctaccaggcagctctggaggctcccgtggccatagctaacagtgcacaggagggcccctggcccaggatgagccctcagaaccttttagagagagtgaaattcagggtctactgggtgtccaagctgcagagtggagcgtgagaggtcagctgccatgtgatagaaagagctgacataaga

SEQ ID NO: 2352 - DNA, 456 bp, Homo sapiens
  ref <308>: DATABASE ACCESSION NUMBER: Contig45847
  ref <309>: DATABASE ENTRY DATE: 2001-06-18
ggttttgagctttataaaaatggcatcatactgtatgaactgtcttgctttttcatcccacgttgtttctgagaggtgtttgtgatggagcacagggccacggtgcccatgcattcctcaatcatttctccagtcttctgaggatgggcttctgggttgtttgcagccttttgcttgtcccagtctcctagtttctccactgcacccgggagcatcacgtttgcaacaggcagggcaggtggtgcatcagatgtccaggacacagtcatttgacacccaagaaaggagggcctggggcctgcatcaggccatggctgagtgggactttgccaggctgtctccgcacccagcgacaggactgtgcgtgctgctgcttcttttgtttcctccacttctgttccctcatccagagagggcggaagagctggaaacagaggctttgtcagggaataagga

SEQ ID NO: 2353 - DNA, 489 bp, Homo sapiens
  ref <308>: DATABASE ACCESSION NUMBER: Contig45891
  ref <309>: DATABASE ENTRY DATE: 2001-06-18
caacatcacagtcacaaatgtttatttggaggacctgacagccaggtctcaattgctaaagtgttgccacaagaaggaagtattaggcttgtcctgtgtggttcctgagggcaaggccaggtttgatgggcaagggtgacaagaaacccattttagctcaaggtgaaggaggatgttcaggttgaagctgcccaggagaggaacaggattgctgataaagaagtgtcctgtccctgcatgggttccagcagaggccaggtatgcagggacgggcactgctcaagtgctttccctccctgcttgtgcttaaagtctgattctagggaagactctggggctggtgcctcctggaggccctctgcctctgtccctacatcatttcctctggaactccggcctcactggtttctgcgggaggcgcttacgtgcaacaagcctggcccgcatccttgtctcaggaccgtgggctgtctctagggtggtgaggga

SEQ ID NO: 2354 - DNA, 907 bp, Homo sapiens
  ref <308>: DATABASE ACCESSION NUMBER: Contig46056
  ref <309>: DATABASE ENTRY DATE: 2001-06-18
aatgacaaagacatggctttaatgttatccaggagacatctgattcacatagggttactgaacactagaatctgatcttgaatctctcatgtcaacaacagacaaatgcattacaatttagggacagctgttttctgggtacctcccaggtgtttgcagaagaaggctagaatttgcttccaggcatcttcctgggccttagaatgagccctgggctccccaccccatataacatgtttgttcagtaatctgtgaagggaagctgggcacagggggaagtaaggaggctcgatgtaatgcccagtcccagggtaacagatgatctggggtttttcctttccatgggcctgtaaccgttcagagactgtttgggcatacaactcacttctccagttatggtcatcctgaccaacaatgagcaggatgggcccctgggccttctctattggaatcatgctggggttcttgtaccctcctacgagagcattccttatatccacgatgtccacgaggcctgagaaagctaccttgattctcctcaggtcatagcccaatggtggaatgctactgtgcttatagttgatggctgtgttcccactgatcccagatccattgatggaaactgtggctgagacattcttcaagaatgaggccattgagagacaaatatcagctcctagagaaatgcccaaaagcccaatgcctgggccttttacctggggatgttgaagcatgtagcatacggcctcttcgaagtactccagggatatgttgtccatgttattggggagatcttcaaagttataataagctagagccaacgctgcaaagccatggccagcaaggaggctggctcgatattccaagaggccccctccaataccaaagatgtcaatgatccctggga

SEQ ID NO: 2355 - DNA, 468 bp, Homo sapiens
  ref <308>: DATABASE ACCESSION NUMBER: Contig46062
  ref <309>: DATABASE ENTRY DATE: 2001-06-18
caatgaataaacatttattgagcaccggcaaatcccagacactacagaacacacagaaggcatggccccacgccgagggccccagccccttgcaaagctgccacgctgccaaaaatggtggcgcatgcagctcaggcgcaggctgaggctggggcttggccgggcagtgcacttggaacggggtcctaaggcctctgccaggttccagctggggcaggggtcacgtcgcttcctgagagcagagcaaataaataatggagaggcaggggctggggcctgaggtggaggggctctggcgttggcttatgtgactccataggagcaagacaggtggccgggagcccccaccccagggtggggaggcagagccaggggaccacagggtcctggggcctccctggcacctccactggtccctcgcctctggggccaaagcagggtgtggggggacaccccagaaggcactgc

SEQ ID NO: 2356 - DNA, 479 bp, Homo sapiens
  ref <308>: DATABASE ACCESSION NUMBER: Contig46075
  ref <309>: DATABASE ENTRY DATE: 2001-06-18
atttataacatttcctttatttatcaacagcaacgatatgacattacaaagtgacccatgacatcttttttaatcttgcacacgcactgcagcaaggttaatcctgtatgtgaaaacctctgagtgactatctcaaagtgtatatgtcatataacctgctgagttttctgatattgtaatactagatacaagatgtctgaataactccttacatttataaattcttatttaattttatagctttaatgcggtccatcatttctaataatgatattggctacaagaataatgatcatattatttatcatataatttaccatttgtaaagcaacaaattgcccattaacaatgaaattgtagttacagcatctaaaattattagaaaattatattagcatggaaatatgttcatgatatatcactgagtgaaaaaaatctggctaccaaatatgtagtctgactcattcttatttcaaata

SEQ ID NO: 2357 - DNA, 631 bp, Homo sapiens
  ref <308>: DATABASE ACCESSION NUMBER: Contig46164
  ref <309>: DATABASE ENTRY DATE: 2001-06-18
catgaaacaattcatataaaaatataaattttaaggtcactcacagcaaaatatggcacattagaattatttattaaatgctttatacatataaaggtaggcacttcataaaatttgcattttggtaaaaggcaacaatttgatgtcagtatcttaattgtgtcattaacttttttaagagaacagattatcaaaattttacgaagaagaaaaaaataatagttttaaggaaatctacagaagggaatctgaacttcatttcccactttatttttgcgagtctgttgtgtatcttcatggtcaagttctgagatttttgctccctgacctaaaatcctgtgggaataattgatttctcatcttttacttggaagtgaagtgtctgctacctgtggaacttgatacaattttttttttctccccacagttagaataacctttattctgatccactataaagccagatgatttttaggtggcagtagctggcattgaagagttcttggcttcaagcggctgttgagtctttttggtcttgttttaactccctaattaaataaataagatccaactctttctgttgtattcactcctggacatatagaaattcacttcacacccacctaaaata

SEQ ID NO: 2358 - DNA, 726 bp, Homo sapiens
  ref <308>: DATABASE ACCESSION NUMBER: Contig46218
  ref <309>: DATABASE ENTRY DATE: 2001-06-18
catttagtgcaagtagcaagtttatttcctttgatatagaattaacagagtaatgatgcccaaatgaggtaatattacatttgcttaggaaaactttccttgaaacacttatttagatctttgttaaagttattgattgtcagatcagagaaattgcaatcccaagtttattcataaaataaaaaaagttgttactttggaaatttcaaaatggcaattttatctcagagtcataattacaaggggaaaaatactctcttagccaagatcaagaatttcggcagcactgcaattctgtttacatccacgttacacaaaagcacatgcatttggcaaagagagtgcatacattcttattgcatcatttttcgttatgtgctcaattgccttatggtcccctagagggtctacttaacatgaattcaacaatgatgataatggggtcaccagtcatttccttacatatatagctctgatgtattcaattacatgtttttgatgttgtgctggtagtatatagatcccaattaaggagaaacttgggcctatataaacaatatatatggaatatacatggatatgtaaagacttgaggttgatgacctgacatccattaatgttaaaaatagtaaagtaaaaattccagtggcttagaaagatggtattttcttaaggacacactgctgaacacatggccacctacctgctctctaaagcaatatgtat

SEQ ID NO: 2359 - DNA, 431 bp, Homo sapiens
  ref <308>: DATABASE ACCESSION NUMBER: Contig46223
  ref <309>: DATABASE ENTRY DATE: 2001-06-18
cttgtccaagatcatttattgttattattatttttctctcttaattggattcagcgtttctggctcctcacacacatcctctctggtgggggattcaggtttgtgcaaagcacaaaggagcttgtacccacctgggcccccggccagcagcacggccggctttgatcggagcccctcttccctgtccgggctcgcctgccccagtccctgcttctgacccctgagtccggcctcccgagcctctgcctgcaccctgagcatccccaggacggctgggagggccaggtcttccgtgatgcagaagtgcctgagatggttcatgaaatgccctcattgttccccttctgctaaggccccgcgacgcctccctcctgctgtcccacacagggcccttgctgggtcacacaccaaacagcctcaaggaaaaattc

SEQ ID NO: 2360 - DNA, 501 bp, Homo sapiens
  ref <308>: DATABASE ACCESSION NUMBER: Contig46244
  ref <309>: DATABASE ENTRY DATE: 2001-06-18
ttcatcattacaaatagactcatagctctttaatttttccatttaacactttaattttccataggcctagattttcaagaagtccaatatctctcacttgaagtgtcttttccctggagtagattgggagatttgagggatatctgtccaaagatgagacagtctgtttctagtttcccatccagcctgatggggcgtctacagtttttaccacaaggtgtcgctgttgaacagattctggtgcagtctagtgcatagctgtccacttctagagtgatcacttgctgggccaagttcctctccttaagtggtgtctcacattaaggttcccaaattacagactcattaattcaccctaataagctcatccaggcagtttaggtcttcaggggcttccagcctccaacacacattgggccaaaaccagcctgtaccaccagctccaagccctgtgttgaatctaggtcattggtccagatgccccttcattctgggcctgtg

SEQ ID NO: 2361 - DNA, 462 bp, Homo sapiens
  ref <308>: DATABASE ACCESSION NUMBER: Contig46262
  ref <309>: DATABASE ENTRY DATE: 2001-06-18
catgtttgaaaccttttattaaacaggcaatgcattgtgcagtggttaaagacacagatgcctagtggaaaagtttaaaaattatttttggaaacagtctatgaattgatgaaccctgccgtgttccttcatctccttctcagagtggctgtctttaggaaaacagattgttttatagctgctcttggaaacggcatccctgttttgccatgaatgtcatgcctcgtagtaaacatgaaagaagacaggatccacaggcaagagagcgaccagagacatgggctgatctcagctggaagcacagatgtcccttctcctagaagggcttctcttctggcctttgctgggtgtcctatttatgtgtccaatttcatttctattttcttccttgtctgaggcttctttatcaagggaattcgaaaagacacattcgtacctttgggcacaggaactggttcctgg

SEQ ID NO: 2362 - DNA, 477 bp, Homo sapiens
  ref <308>: DATABASE ACCESSION NUMBER: Contig46288
  ref <309>: DATABASE ENTRY DATE: 2001-06-18
aagttgtaaaaaaaattttgttatttataaatcaattacacaataaaataattatttttaaaagtcacaaatacaatcgttgtataaagtcattttggcatcaagtatctcttaaatatgttgcaaactattttccaaagagatgtggtccaaaccctctgaaggctttataattttgtattagataacaagtgaacaaaactgacaataaatactccaacaattattttttaaaatactaagtggcaaatgctattctaagtggcaaaacaatctattactcagactacctgaaaatttcactgaagtcatcaaaagttatacaaaatttgtatttacatgtttaaaatcctgattgcatttttctttaataataatacatacaaaaactcagagggttaataaagaaataattcaaagtcctaataagtcaacaaacagatttcattataagctgaacataaaagagacaccatt

SEQ ID NO: 2363 - DNA, 461 bp, Homo sapiens
  ref <308>: DATABASE ACCESSION NUMBER: Contig46343
  ref <309>: DATABASE ENTRY DATE: 2001-06-18
aatttctaaacatttttatttcaaatctcttttcacccctccccaaaaagacatgggtaggtacagcaatcataaaaaggagatacaaacacaagagtcaaatgtctctcgcactgacacttacaaaaaactgggaattgtacatggggtttccaaacaggacctgcagcagctactaacgtccctttacgagagtcaaacatgcctattaatacagtatatacagacaccccattctggaactaatctacagggacatccctaaccccaccccctctatccccagaaaaataccaaaacacacccaaagtgcatttgttttgtttatatcaaaacctctttccctttccccatcccaccctcagacccctcccaccccatttaagattggcctgcaagtctattttaaccatttagtatttttttatagtttatgaaaataaattatacagcaactattt

SEQ ID NO: 2364 - DNA, 524 bp, Homo sapiens
  ref <308>: DATABASE ACCESSION NUMBER: Contig46362
  ref <309>: DATABASE ENTRY DATE: 2001-06-18
gtgatgggggagaaaacacttcattgggttcaaagataatattccctatcataaatcagtggcataaacagccagtgggccaggtgggcccaccgtatgctagctgacaagggcagtcacacaccggtaagtgctgatacaggatgaggggtgcggagctgaggatgttgttctctttgatgaaggcctgaaaacttcccctggcccctgctgcccacctcagggctcctcaggacgaagggcatgaggacaggttcccactctggcccttcgctgggggacatggtttggtttccccatcgccaggctggccagctggggcccaagcactgaccgtccttccccaccttatcccatcagctgccctgcacaggagcagaaaacccatgcctcagagctacttcctaaggacactgcctctagaaggccctaaagtggcagagccggggatggcaggtgcagccctggccactagcacagcagttgccctcagatctgttagctgtgacccatagattggggga

SEQ ID NO: 2365 - DNA, 611 bp, Homo sapiens
  ref <308>: DATABASE ACCESSION NUMBER: Contig46443
  ref <309>: DATABASE ENTRY DATE: 2001-06-18
ctaatgctatttattatcacaataaataattcactgcaaatgactgcatgaaaaatgtgggttccagagcaccatgtataaaatgatcccatttatgtagaactgtaaacatacatccacacactgacggacaggtacatatgcatgtttggggaggggtctggaatgatcacccaagtggacagggtgaggggtggtttcctgtattttttacaataagcatttatgacttttacaaaatcaccaaagctatcactttttccatttagaaaacacaaaattatttttaaatagagacttgacgtcatttgacacaccttggttttctctcggagagcacagatgccgcagacaagaggagcggacccgcctcccagactcctgcctgccccgtccctcccccgcaggtggcactggtgagccgggaaggtgctgccagccccaggatgcctcgcacagcccgggctggaaacccctgcccctgcttcctcgcacagtctgtcattctagaaggctctctccaaaccactcttccaaagagggtcatgccagggaacagcagcgaggtcattttccagtcatcccacaggaagccagtgagccccactccc

SEQ ID NO: 2366 - DNA, 601 bp, Homo sapiens
  ref <308>: DATABASE ACCESSION NUMBER: Contig46452
  ref <309>: DATABASE ENTRY DATE: 2001-06-18
aggaccaaagaactttatatttattttaaatatcaaagtaacacaaagaactagttcaatatacagtacacttcctactcttcacagagaactgaaattttctataaagacatttatacttaggaaacatcagacaaccaaagtatgtataaaactcacaagatattttacacacagttcacaataattaattctgatattttagatttttctgtcattgcttttaaagtatccttaattaaaaacaaaaattattatttgagactgaaaacaagtgcaaaagcatttctactttaatatacactgtaaatccccataatcaaaacatttactacacaatgtggaacagctaaatgcccagttttgtattattttctggcagccacactcatcaattgtaatacagttttatcaatagggataagaagagttcaatcgttagaaggaataaaaattttgtaattacatcacagtacattgtccagctttaatgcaagcaggaataccaagcaaaaaaatacgcagtaacaatgagatgtgtacatcctcttcattcaatacatcttttagaatctccaacagcaatgcaagcattgattac

SEQ ID NO: 2367 - DNA, 686 bp, Homo sapiens
  ref <308>: DATABASE ACCESSION NUMBER: Contig46553
  ref <309>: DATABASE ENTRY DATE: 2001-06-18
cactatttactgaaagtttaatgaaataaaaaatagaataataaaacaatcaaggaccaagggataatcaaaaccaagtacatttgaaaaagaacaaaatagaactttgctatactccataatgataaaataaaaatccaaaaataagatgtaacattcaaaaccttatatgcacttgactacagaaccactactatgtcaataaataactgacagaattagaaggagaatttcaaatttacaattgtagggtaacctttcaatattctgtatgagtgttagattctcatattacaagcaaagaaaaatgctaatggttttctaggatttgaacaagacaataagcaaatttgatctatgattaccttcatttgacacagaaaacatcccttctttttttcaaagcacacgttggacaatttcaaaacaaattaaccctggtttcagaaagttacagaaattaaggaacataactacaaaaagggagatataaagaatgacaagagaatgctgtgtaacttttacaaaaaattaaactcagtggaaaataattttcaaaaaaaagaagaaaatagacaagctgactaaacaaattatgattatgaaaataaggtaggcagttaaaaaatattttctacgtccttccacccaaatgctgccaagtccggtcagatattccaagtttt

SEQ ID NO: 2368 - DNA, 431 bp, Homo sapiens
  ref <308>: DATABASE ACCESSION NUMBER: Contig46597
  ref <309>: DATABASE ENTRY DATE: 2001-06-18
aaaggcacagctttcccagtgtttgtgttccttgcttgcgccctgttttaatgttgtagttacaggtgtccagcagggaggaatgcagcccctgtgggcgcttgggggagctgctgggaatccaagttcaaggagcagctgttttctgttttctgttgccccacagcgccacctcctggccccttggtggtgatgattttgaagtcagcaggttctggtgggccgtgtgaactccagcagctctgggctgagctgtggaaacactgcgtcctttgaaataatacagcttcctgagcccaccccagtccctaaagactgcctctggggttgagattctgagatgcttgacagcatggcttttcccggtgttatgtgtcgtttctatccttaagcctggtaggggtggactggaggctggaccaagctccact

SEQ ID NO: 2369 - DNA, 476 bp, Homo sapiens
  ref <308>: DATABASE ACCESSION NUMBER: Contig46653
  ref <309>: DATABASE ENTRY DATE: 2001-06-18
taaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagccataaggaatataataaacctttttcaccacagaaccatctgtcacagataatactgaaagttacacacttaggaacagtcagaccacagacaaggtcagactggctgccaccaccaagtaaacaactagaaaaggacagcggggtccaagggtgggggtccctgtgcacgagtcgccctcctctggcctgccccccctcgggtcacctgtttctcctttgccccaaagagggtggagtcaaatgcagattttcctcccaactgcctgttagtgtctcaacaaggagagcagagcccaggtcag

SEQ ID NO: 2370 - DNA, 419 bp, Homo sapiens
  ref <308>: DATABASE ACCESSION NUMBER: Contig46709
  ref <309>: DATABASE ENTRY DATE: 2001-06-18
agatgccataacttcatttaatattgatagcagctcaatttaaattttgaaaaagcaaatacatttaataaaattggtgtgaattattacatattttgatggaactactgtacagaatgtatacatatataaatctatagatagaattatatacatttgagtatataccacatacatattttttccactcacatttttctctttagtaaaacaaagcagttttactgtacacagaagtgcaatgctacattaagtcctgagtaatttaaggtatcattaataaactgctataaattctagttttccagccaaagatccaatagattctgtaacaaaaaatgtgaataatacttaaaaatatgcatttagctttgcgttcattttgtgcttagcagaaaaagctcaagaatgcacagtag

SEQ ID NO: 2371 - DNA, 958 bp, Homo sapiens
  ref <308>: DATABASE ACCESSION NUMBER: Contig46777
  ref <309>: DATABASE ENTRY DATE: 2001-06-18
aaaaaataaaaatcatttatttaaacaaaaatatacacacagtgtacaatgaatatggtttacacagaacaataaaacaaaaatgatatctcttaaatgccaacataaaatgatctatttatgcctagaaaaaatttctaggaatacacattattgattcatctaaaatacatatataacataaaaagaaaacaaatgccaacctttcagatgagtaccacaaaaacctaaaagttaaatgttagattaaataaaattataaaatatccacacgagaagtatgtgtatacaaagtattgtatgtatgcagtgaaatgagagtgcccatacagttatatgcaaacttttgaaagtttcatagttgtttaacaaaatatttttaatgttgatagtgacataaaaacatcacaagaattatctagataatatagcaatattgccaaaatttgagtcaatgttacctgtgagtgcaataggtcatcattgatcgcgtcctttcatgacctggcggtaatttagatgattgaaggaatattatgaatgtatttacactgtgagtgtgaaagggcaacatttttcttcctaaagaactgtatttactaaaatatattttttttggcaagatgtgatttatcaggcaacatcacttgtattaggtcttccttcccttggtactcactctctgtgggtaccatactcaattgtaaatcttttaaaaatttaaaattctaagtatgcatgcaatctgtaaaaattccaatttaggatagctaaattcattacatttttcttttttgcttatattaccttactattttacctgtctccttgttattaatagcaagacatatgttccttttagaaatgtttgattctcttatttgcttagaaatagaattcaatgagtgattaatgtacaccatgattcagaaaaacaaatgcaaatttccatacatta

SEQ ID NO: 2372 - DNA, 531 bp, Homo sapiens
  ref <308>: DATABASE ACCESSION NUMBER: Contig46802
  ref <309>: DATABASE ENTRY DATE: 2001-06-18
aacagtgatatacataattcaatttttattatcaccagtctttatcaatttagctgttctcctattgttcaagaaatgttatttggacaagttttccatagggcaacttgacttcctctttattcatttaaaagttgttgtctccttcaaagatatttagaggttgatctggtgagccctggaagtctaaagtcattttgtggcttcagaggcaggaagaactcccaacagcgatgtgtcgctagcatcttcacaaccatggttgggggtgtcatctgaggttcttgtcccatgtgggtcctctctcttgaggcaggtctccatctcatggaataaattctcctcgagagaacccctccttctggttgaaactctgaggggcagatgtttttgtttctgaactcggcaccacgtgagaaatagaataaacagaaccaggagaaggagcccaaagatactggataaaataagtgctaaatgacctgaggaggcattcagtgatttcagcgactgtccagagcacctcacgcc

SEQ ID NO: 2373 - DNA, 615 bp, Homo sapiens
  ref <308>: DATABASE ACCESSION NUMBER: Contig46868
  ref <309>: DATABASE ENTRY DATE: 2001-06-18
ctaagatcccttctttatccacatcacttcagccaacaatctgattggtatttccaagacaacagagcagtatttcaaactcatgaatgggattttaatgtgctgtatggaatttgaagcctcaaacttaaggaactttccacctggaaagcattcttaagtaacatcaatgaactgtcctccctaaaacctagacacagtatcactgtggaaacagagtaatagttctggaatcgattgaggattaggttagaagcgcccacaccaggaaaagcttccgggaaacggttttaggacagaatcaaggcacacctgtggaacctctttctgcatctgtcaaatggggacgctgtgtctcctctcttcttaggagaggattaaatgagccagagtgggctagcacagtgcctggcatgagactacagtttcactgggtgctatactcactacctgggtgacaggatcattcgcatcccaagctcagcatcacacaatatacccatgtaacaaacctgcgcacgacctcctaaatctaaagtaaaagttgcaattaaaaaaaaaaaagagaaaaagactatactttcaacaaatgccaactccttccctcattctttc

SEQ ID NO: 2374 - DNA, 476 bp, Homo sapiens
  ref <308>: DATABASE ACCESSION NUMBER: Contig46890
  ref <309>: DATABASE ENTRY DATE: 2001-06-18
cctaagaatgacaacttttattaatttaaaatatatatttgacaattataatttgggacctatataaaacaaaaatataatcacaactattttatggaaaaatatttattcatatagagtgaaaatacctccaaacttagttatttgtagctgtcagatgagaagtatttcctaattacacccattcataaacactcattttatcacttcaaagagcaccagtgtattttttcaacaaaccagaaagtaagaaggtaggggcttatttcatgtaacagtgctattatgataaggcaccactaggtatatgaaaaagccaaagtatttccaaatcatgtgtttttgttactggtgtcttaaccattagacaggatggttagaaaaaagctgctaacattattaatgaaccacattatagcccctttcccaccattctgtgcttttagttttacttataacagaaatgaaaacaacaa

SEQ ID NO: 2375 - DNA, 575 bp, Homo sapiens
  ref <308>: DATABASE ACCESSION NUMBER: Contig46922
  ref <309>: DATABASE ENTRY DATE: 2001-06-18
aagtattacatcaatcatttattctgattttactgaatgacagtaaagagaaaccatttacagacatgaagctcgaaaatgttctacctcccaatgcactagtatttcagagacttggaatatatttggagatgtggaaaatgattacactttagtaacactgagtaacaattttaggccaagtatactacactcatattttttttgaagtgagacattagtccaccctagtactgcatacagacacactgagtaataaatatccaatctgtgatcatctttataaagggcaatttattcgttgctttccccttaccccattcgccctagagtggcttcgtttcactttgccctaccccttctagcaggtagtaaacagtcctggccagtgatgccatctggcggttagttcagaaattgtttaaccaacacaccttccaatcaggatcttaccatcgggaccctctccaaaaccacactcccctttcttccagtttttgcccatttaccttagtaaaatcgggttttcttctttcctgccctgtttatccaactgaatgaaaaacgtattttat

SEQ ID NO: 2376 - DNA, 710 bp, Homo sapiens
  ref <308>: DATABASE ACCESSION NUMBER: Contig46934
  ref <309>: DATABASE ENTRY DATE: 2001-06-18
cagatttaaaaaacatttattttaataagactattgcaaacacattaaaaaaactaaatagtaatattacaaaatctatatacttgcacatttagtatttgtcaatgtgccagaggttttcttcatgaaatttgacttctttgaagtgaaggcttttttccatcatctcttatagctctgactgaataagtcttaatgctttcttcatgttttctatcaataggggtaaatcccgaggctcatatgtgtacaatctgttagagtatcttccagctatgtcagctctaactgttaaagaagggtctacaaacatgattctaggcacatattgcccatcaggtgataaattcttatcagtggtttcatgcataaggtttagcatgatgaacttattctgagccatttcttgtatttcttcattttgggcaaatactttctttagtgcttgagagtattgacaatcctccaggtgatgaataaccattaatggcttcttacttttttgagcataaaagagaccttcttcataagtttgtacccaagtgatgtcatctccccatcctcttgagagtgtctgaggaggcctcttttccttttttattgcaatggcaaggttggaagaaactgtgacgagtaagaggcagagacccaaagctgagtgtagcatcatgtcttctagagactctctcagaagaagctgacttggccag

SEQ ID NO: 2377 - DNA, 495 bp, Homo sapiens
  ref <308>: DATABASE ACCESSION NUMBER: Contig46937
  ref <309>: DATABASE ENTRY DATE: 2001-06-18
tccatttaaacatttttataatttgtttcattttcaaggcacaaagagtttatgtcaatcattttaatgtctaagaatacaaagttagcactagtaacatctggtagtctaatcatttatcatgcttaaatgtaacattacaaaactacattttaaaatctgccccctaaccagatgtgaaacaacgtggacaagggtgacatgtgctagacccaatctccaaaaacgtatggttgacaaagacagctgactgctggggtaaaactgcagcagtcataatcgaagagcgaaagaggccactctattaaagactttgtttcttttgctagacatttttcacctaatcccaggatagtttctgttaatgcatcttactctctttcaaacgaatcgtccctagagcaggtgtacacattaaaaatgagctttatagcatcaaacacataccacaaccaactctacaaggagggttttctgtaagatgtgtacgactgt

SEQ ID NO: 2378 - DNA, 738 bp, Homo sapiens
  ref <308>: DATABASE ACCESSION NUMBER: Contig46991
  ref <309>: DATABASE ENTRY DATE: 2001-06-18
agactgaattgaatgtctttaatttcacacaatgaataacatatgaataggattaactttttttttttaatagttaagtgctctatactgtgctaacctgatctggtagcggaaaagactgagctttcttttagaaaaaaatgtttaaaacccaacatctaagaccatggaggagcatgacagtaagcatgctagatgtatctacgcctcaaataacagcaagtccatgttcattttaaatgtacaaaaatgctttatgaataaaaactgttacaaaaagaacatttcaaacaatgtacaattttcttgcctctatattcaataaaatacaaatacattttttgttctaaaatatgtttacatacaatcaaagtagaacatgcaaattacactttaaaaaaggcttttaaaaaccacttatgaatacaaactaaaaattagccagcacgacttgtaagacaatcttgtgccccattttttcttttgaaatatatatgtacatatttaacacatcatgtgcatttattattatttaagaaatagattttttttaaaaaaaggaagaaaaagaaagacaccaatctagggtggaaccgcccttccacgttgaccagttggcagctcctttcaatttcccccctttagtgtttattagacctgggcaagtgggcaatagatatccaggaagtttcttccttggttgatatgtgcttctaagactgttccccaaatgactga

SEQ ID NO: 2379 - DNA, 761 bp, Homo sapiens
  ref <308>: DATABASE ACCESSION NUMBER: Contig47016
  ref <309>: DATABASE ENTRY DATE: 2001-06-18
accaaaagtaaaaaaaatttattttatagagtggttgatttttgtaatacatcaaaaactgtgatgttatacacttccctattctcattgcttatctcatatcagtggttgaagtttctcccaaataatttagtttacatttaaagtggcaatacagattttacttaatggacttaagttataattagaaaccagttttatatacagaaaatccataaatatagaacttttattcctattttatctttaggctatgcaaaaaatggactaaaaatttttcatttgggtctttgtaataaacatgtaaatacatatttacaatggagatgcttcctgatagaaagtaaacagaagtaattttggtcttcactagaatccatcatatctatttttgaagatgatgtaatacatcatgtttactcaaaatttgattccttttatacacataatttaaataattactccacttttaccattaatgtttcattctgtatttaaatttccttcaagaaagattccttgatccagtagtagggaactctgtttctgtacagttaatgtgtaatttttatccttctggcaatattacaaatactgagtcatttaatcttcattgtttattctccaggggtaattcttgagttatctcacatgatgtaagtaccatctttgcagtatttcatggattccatttgttttgtcatagccagaacatcatgaaatccagtacttaggccagacatatgttgaaagtatgcctc

SEQ ID NO: 2380 - DNA, 420 bp, Homo sapiens
  ref <308>: DATABASE ACCESSION NUMBER: Contig47045
  ref <309>: DATABASE ENTRY DATE: 2001-06-18
ttggtccgggttagctttattggagcctcctagcaggccaggtgtttcaggcaccagtagtgctgcaggcacgggggcctgtggtgtggccagctgcaggtgatctcggtggtggactccgaagtgtactccagagaggtcccggaatggcaggggaccagctcgggcactgaggcgctgctggcaggctgtttcgacgattccttctggcgctgtccgctggtcttgggggctgcgtcctccggcttgccagaggacttgctggggggctgcgtggggatgttgctgctgctgggagactggaccatgggtgagaccgggctggaggtgacgttgggtggctgcaggggccccgaggacgggagggctgactgggaggggctggaggaagtaccaggcggctgggtgtgttgccgagac

SEQ ID NO: 2381 - DNA, 420 bp, Homo sapiens
  ref <308>: DATABASE ACCESSION NUMBER: Contig47106
  ref <309>: DATABASE ENTRY DATE: 2001-06-18
tatgcaaatagttctttttattattaacattagggtatgtcaaattttaaaatatttacacttaaagacaaaacatttccacaattattacaattggtttcactaaatcagaagtgactacacattatctctacttttataccagaaaacaaaatgaagaaatcaacaaaatataattactaaaactccactgtggatcaggataaaatgtgtccaatattaactcacactttcccaataagtataaaaatgaatataacattgcttggacaacttgtttcaacagcgaatcctctattactatttgttcaataacatatataaattcaaaactggcaggtatgaaaaaaggttactttgttttttgcagatactgtacttgtaaaataaagccaaataaagcatatgtcacacatacca

SEQ ID NO: 2382 - DNA, 854 bp, Homo sapiens
  ref <308>: DATABASE ACCESSION NUMBER: Contig47146
  ref <309>: DATABASE ENTRY DATE: 2001-06-18
gaaaaataaatgaaaaaaattttattgagtattactttatacatgcaaattgaaagtgaatctatattaagttgactattccacaataaaaacctatgaaatgggaatgatcaaagctaacacaatactaatgtgttcaataaattatccagatgtttttccacaaatatttggattacctgaattagctgattcttcagcaaaagttaaattttagctttaatatggtagcagcaggatgctacttaaatttagaagaaaaacataagaataaaaaccctgaatagcatagccaaatcttccaagaaataagttcaccaaaaaagtagcatacacctatttggtatccagaggaggaaacaaaacacaggcacttaatcaacatccaccaagtgatcatcactaacattctattattaccagagtaactgtcgatatgtgaactgtagattagaacagacttacatatctaaaaacaaaccagtaatcaataatatatacagaaatactaacttgaagtcacatttaaataccatcaacagtttggtgtatctgatataactgaattcatttcatcactgctataaattccttaaaagtgttcttttcctaattaacattatctttaaaaaatggtagatatttcccagtatgcatcagttttttcactccaccattcagtaaatgttgtagcaaattaaatagaacctattaactagatctaaaaacagtggctgaatacttaacacaaagaagtacttttgagtaaactattcagattagacaggctaatgctaagactgcattttgtgctactgacatgcactatatagatcgtacactactagatggaa

SEQ ID NO: 2383 - DNA, 473 bp, Homo sapiens
  ref <308>: DATABASE ACCESSION NUMBER: Contig47230
  ref <309>: DATABASE ENTRY DATE: 2001-06-18
cttaaaatgctgatgtttaatgatctacactacatgattaggctcaagatgtgtggattttctaaaacactgatctgagatctcaaacacatgcaaaataggataacaaacaagtccaaagctgctcagccactgaagagtcctcaggagagtagtgctgatgtccacggaatgtgggagcagcacatggacaagcctgtgagtgggtttcactcagtggaatccctccaagcaggtcttgttcaggaggctgaactgagtcatccagggcctggtgctgatggtgaagaagcaggtgaaagtattgttcagctctgtgctttcttggaaatggcagttgtcaatgtcgtcttcaaatttcccacacctagttctccccagcagtagctccattgagaatacagtcttggactccacctgctccttccaggaattcaagatgtgccccagtctgtaggcatagtagtccttgc

SEQ ID NO: 2384 - DNA, 640 bp, Homo sapiens
  ref <308>: DATABASE ACCESSION NUMBER: Contig47405
  ref <309>: DATABASE ENTRY DATE: 2001-06-18
actgtgaaattctaaaatcatatttattcaccaattcacagaaagtgtcataacgaccaccaacatgaatcagtttgtaggcatttacaagccacagctgaaaataaaaatctgtctgtgttgaataggcatttaacaaattacttgaaaactgcaagaatcataattattataaatttaaagtttgtgattcaaacatgggtaagatcacagtcatggggagaagcccaacagattcctgtgatgatccttattttcttcctatatctttatatacatagagactctcagcgcccctcactctgtgtcagtctgaattggatatgacagctcagttaggcctgagagaggattctatgaaaaggagtggggaggggaaaggacattttctctgaccctctgtggctgggcaaccttgttgactgagaagacagtgcgctcttctgaaattagattcaattttctataaattcatacagtccttctaatgagatactccaaagtctgcattgtttcacactcatacacaatagtatatttatcaaataaacacattttctagactaaaaagattcattctttgaggcagcttgaagagctcagaagtctgatacatgtcaggtacacactggtccaccgc

SEQ ID NO: 2385 - DNA, 803 bp, Homo sapiens
  ref <308>: DATABASE ACCESSION NUMBER: Contig47456
  ref <309>: DATABASE ENTRY DATE: 2001-06-18
ttgctcctctgtccccagcaccccttatttcttaagcagcaccaccagtccccagaggacaagagcagctatatctcatccacctgtgcatttctgcaccagcgatgcaaaaaacaccctgggtgggccacagagaaaaccgtaactatggatacccaaggggcagagcagccagctggacctgctctgtaattcacttacttaccagagggtggttcaagtcaaacaaacaaaaccaaagacagttgcaacccatggtggatccaaaggtacagtatcaaaatcatggaactcttgcccaaagaaaagactgcaaatagtcatctggtatatcttgtggaaagatgataggtttatagtgactcaaaatattttagaaaaatttctgtagtgtcaagttctttcaaacttaaaattttaaccccagaggattttcgctgaataaatgagaattggctctatttcttctacttctggatagcccgagtaaaaatactaataatttctagattttagtggggaactacaattattaggacccatggatattgctgcagttcaaatacaatacagtaattacaaaatatagaccatctctttacaaatacaaattatagtatattacaagtcatgtacagtaaatctataattttaaacaaactagtgtatctaagtttacctggttgcgagtgcattattattccagtttacagttgcccttagcgtgacagtcagaaaccgaccatcggagtgatattctcttatgtaaatggcgtcacatcacagaaaaccttatttatgag

SEQ ID NO: 2386 - DNA, 545 bp, Homo sapiens
  ref <308>: DATABASE ACCESSION NUMBER: Contig47465
  ref <309>: DATABASE ENTRY DATE: 2001-06-18
actttgagaagccatttattttgcagccttcagtccaaaaaaagtcaacattttcagaatttttttatataagttgtaggtcatttttataacaataaactttctattatctatttatctctcacatacatttcatgtatcctgagtattatgttacaacaatctgctcttgatagtaatgttcctgatagattaaaagattgagaaatacttgaagaacgatcaaagatacaatgagcatggtatacttttgggttaaaatgtattctttgataactgatgtcatatagatccctaagtaaatcaaatatttaatttcctacatctgtctaccttagttaactggcccattcctataagcttaacaaaaactcactttacaattatttaaaaaaaaaatttaagagatttttagaagttaaatggaaagatacttttggacattacaatatttttaatgagttattattttaaaattagagatttcacataaaaaccaggattctttgttttctctttaaaaaaacagaggctcttgcaacagg

SEQ ID NO: 2387 - DNA, 437 bp, Homo sapiens
  ref <308>: DATABASE ACCESSION NUMBER: Contig47498
  ref <309>: DATABASE ENTRY DATE: 2001-06-18
ggaccaagaccatatatcactttaataacagaactccttggaccagttcacagaactgtcatttaaaaccaatgtcctagaccaactccaaccttcttgttttccagtgtacccaccccacacagggccagccacagccaggtgagaacaggaaggggagtggagagggagagtggagagggtcctgactcccataggcttcatctgggctggcccagccttgaccccatctgcccaggagcctctcagccatggagtcctctagggaggcacttagcccacctagagcacaggaaaaaggtgggacggggggcacctcccagcaccctcccaaaagactcacacaggggcagggaggggagagggcagaagggcaggcttcctgctgcttctagcagcctcttcatctccagctcctacctctctcctccccctca

SEQ ID NO: 2388 - DNA, 703 bp, Homo sapiens
  ref <308>: DATABASE ACCESSION NUMBER: Contig47578
  ref <309>: DATABASE ENTRY DATE: 2001-06-18
agaagggagcacctttatttggaaaacagtaatttcaaaatcatctcccgaactcagaatcgatgggtctgggtagataccctaagtaaacaggtgaaatcttcattacttgttcacttattaagtaaaattttaaattaaccgattatgtacaggagtgtttttcacatttcctgataagaatcacttggaatgccctgtaaacacagcttcactggagattaatcctatcaaattgattcagcaagtccgagatgggccagtaatttgtggagatttttatttttacaaatgcttcctgatgatgaccaaatctaagaaaatttggtaaacaacggaaagttatctggaacataactttcagttttctctgcagtttttaagtgctgaactactgatcatcctagagataacccactgaaaagtcttctctaatccagttttacaaaaggaaagtctttttaacatttggtttgataaaatgttttccgaagaaatactttacttgcctgttttcatttctggcccacccgttctacttcacgttttcttgaagggttcatcttctatgagttgaggcatagcaatctaatcatttttaaaataaatggtttcttttttttttttttttttttgagacggagtctcgctgttgcccaggagtacagtggcgcaatctcagctcactgtaagctccgcctcc

SEQ ID NO: 2389 - DNA, 792 bp, Homo sapiens
  ref <308>: DATABASE ACCESSION NUMBER: Contig47645
  ref <309>: DATABASE ENTRY DATE: 2001-06-18
ccccttgtctccatatttttattccggtacctggactggactatatactctcaattaaaaaaaaaaaaaactaaataaaaataattctcaatgcagagttcttcaaagaattcctaataattcacacgttccagcttcagttatcaccgagaactggttaggttccttccacactgggaaactgcatcaaggaaaagagctgggcaaagtcagattttcatgccagccggactccttcgcacccactttcagggagcctcccgccagcctccagacctggtcagatgatatgaccttagctccacacgtcctcagggtgtcggtgtctggggctcccagccccaggcaggccgggcggcagctacagcctgagctcgcggtcgggcttcatgctgaagggctccagccgctcgccctcgggcagcatgctgttgagcctgtccagcaggggcacagtctggtcgatgcccatctgtatgcggcggaggatggcggacatctcgttcactttctggatctgctcggcatacttggcgtatcttttctggcgctcctgcatgaagctgaacagagtttctacagacagatccatctctttgattcgtttaaccaaagcattctggtcaaaagcaacggcctctgcacactgatgcaggtgatcttgatatcggaggcagagctgcaacacctgctgagagtccagtttctccaatttggcatttgttggggaagtctggccactcaatagccctttcaaaaggggctggaaggttggaatctcttgcaacttga

SEQ ID NO: 2390 - DNA, 499 bp, Homo sapiens
  ref <308>: DATABASE ACCESSION NUMBER: Contig47680
  ref <309>: DATABASE ENTRY DATE: 2001-06-18
gcacatagaaacaagacatccatgtgtacagtatcaaaaaatatataccaaggttactggtattgcagttcgtggaaggggaagagaggggagaaaatgaaatcaaccgaaatactggatggaggggaagaaaggtcaaaagaaaatagtttgtctgatatagaatataacatgatctagaggaaactccataaatctaggtttttatatttcaatatataaatacctacaaataaatatatatatagcagcccgaaggggggtggtcgggccttttgagctcaaacaatacatttcaataataacaccacgtacaaacgggagtagagtcagcacttgacaagttagcacggttaaaatataatactagaactctgaggccgggcgcagagctgccctgtccgttccgggggtccatctccagcggggaagggcaggagagggcgagcccgccggcaccgcgtggaaggggcctccgcccaggtctgacagccgccgc

SEQ ID NO: 2391 - DNA, 743 bp, Homo sapiens
  ref <308>: DATABASE ACCESSION NUMBER: Contig47781
  ref <309>: DATABASE ENTRY DATE: 2001-06-18
ctgtacgtatgttttatttgaacatccacatttcttagcttagagacaattatattccgtacacttttcttctctctctcttacaatatttagactggccaaaaaccagggaaaatgtccttggactgcagtcattataaaattttacttaatgcttatgaaagcactcatgtgaaaagcttcagcatgaagtgtaatcaccacattcagtttcaaagttcaaatgcccattcctatgatgggtaaacacctaccatagcgcaaagaaggagagtgattgtgggtaatgacagaggaggaaaagtgaagggggtaacagcttctcccagaggagggggtggtccctgttccatgcccatcttgtctccttaaacaggaacagccaacaggcctaccagtccttgtactctatgcagctacttcccctgctggaaatgagcagctgccttcttctccctaaggtttgtcctcttttatctgattcttggaaacgtttttttaagttttgccaggttctttgttctttcatgaatgaactgatggaaattttctatggaagttacttacctcacttaagaagcacacagcacgtctcgcctataatcctagcactttgggagccaaggcggggggattgtctgagctcaggagatcaagaccagcctgagcaacacatgtgaaaccccatctccactaaaatacaaaaagccaggtgtgcatgcgcctataatcccagctactca

SEQ ID NO: 2392 - DNA, 483 bp, Homo sapiens
  ref <308>: DATABASE ACCESSION NUMBER: Contig47814
  ref <309>: DATABASE ENTRY DATE: 2001-06-18
aagttttcttattctttattagtttaaaggaagctagaacctaataacaatacgccacatacggttcagaaccaaacaaaagctgcttagttatttattttgcatttgcattttgtaggaagtgagaaaaaaacagctctattgggactcaagtttattttcaattaaaatccccataaattaggaaatgtcttataaaacggagaaattggaaaaaaatgttattcagaaaaaaactttcttgagtgtgcttgtttcctgtagcaccttggattttgtgatcagtcttttaaagatattttttaaaaaattcaacctctgtcttcacatttaggacagggcataacagtgtcttgtcctttcatgcaaataagaggaaaaatttatacttgcttagtttcgagcattgaaagcactcgcccctaattctgccatttgctcatgtcccacatgaataaaaggatacagcttagaaaccagggc

SEQ ID NO: 2393 - DNA, 837 bp, Homo sapiens
  ref <308>: DATABASE ACCESSION NUMBER: Contig48004
  ref <309>: DATABASE ENTRY DATE: 2001-06-18
cagttagatagttcctacactgtggttatttaccagactagaatcctctctgggaagtgtttaatcctgcatcaaatacagacaggaaagcattggcttcgagagaatcacagttcactgtaaaggcaagccggtgttcgaaaaggaccattaattcagaaggacccaaaactctggaaaggagaagtcatgatcactgctgtttcaggaacaaccttggtaacttgccagttacgctggtggtggagagaatggaacagctggaagggagacttcttagcgcgctcggcataggcacagacttcactgcttcagaggacacgcagtgcagacgagagtcccaagcttcccagctgcaccaggtccacatggcacttgaaacaggctgcctaagaggccacaacgcccaagcatgctcctttgctcagagacccaggacctcagctgggtggctgtggactcagggccacccttccccatcttccagtgagatgcccagcacagacttgtgggggattctgcactcttgcagagatttggtgaggtcagaaaatcgcctcctgggcacctccattgtttcaatgctgcagtgtcggtaggaggttttgtttttctgttcggccacagcaacaatggtttgcaaatcatctgttggccggaaatggcgtacaaacctttggcctgttggtgatctaacagcaagcagcaaccttggttcttggtccgatggttcctccagatttccagccctggaagagccctgtttcttggttcggacgatgaatttcctctccacggcacaagctcgagctctggaatcttcttcacttgtcttca

SEQ ID NO: 2394 - DNA, 465 bp, Homo sapiens
  ref <308>: DATABASE ACCESSION NUMBER: Contig48043
  ref <309>: DATABASE ENTRY DATE: 2001-06-18
gggaaggaatgtacttttattgaaaatgaaaaaatataaaagtaccatcttcaaagagcatctcacaaacactgtacagcaggtgaagcattgcagtaacatacattgaaacatacagagtcgagttatacaggactagccatctaacaggtcatctggtctccgacggttgtttaacgacacacagtagaaatagagaatagaacccatatctgtttccagagtccaaagtagtatatcaggctgacagcactcaatcagtgagggctcctgaggttgcaatgattctgcaacggagtagattctctaggaaaaaagaccttgctgctaaggaaagagaattaaaaacaaaacaaaacgaaaagctccccaaagaggtactctgctcaaaatggctggtgctactggtgcactaagttgtgaggaattacctctgctcgggacagaataaaaaatcctaggcct

SEQ ID NO: 2395 - DNA, 736 bp, Homo sapiens
  ref <308>: DATABASE ACCESSION NUMBER: Contig48057
  ref <309>: DATABASE ENTRY DATE: 2001-06-18
aacttttaatatatgatttttattgaacatgttcacctttacattattacaaacattttacaaataaaaagtttttgtaaaaaaaaaaaaaaaaaaggaaacatttcctgaattatcactggatagttgaaacaaagaaataaaatatataaatatgaaggtcattctccaagtattagaacagaatacggatggaatcacttcagtaaagttattcataaacatttgcatggttacccacatactgtatcaccttccaaaaaatcaaacacatgagaggaaggggaacctcaaatgagatgtcttttctccatgggatttggtcaacgcatatcagtaagataatttctttgctatatacacaacataaacatttgaaaatgcagaatacattgtgtaaattaaaaattttgtcagctttgttgtatggggagtaactacacagaccacccacacaaacatttaaaatatactgtgtatatattatcttacaaaaatcgcatgtgtaagggaataaggcctttatttccagagcatcttaacataggattaatatgggtatattcatcttttatattttagacttcaaattctttaacatctcagctattaacattatgcgtagtacctaagacaacatatgagtagtggcataacacaatttcaactacagtgcttggttgcattcacatgacgtaccatctagaactgaccaaacagaatttcagaactgccc

SEQ ID NO: 2396 - DNA, 399 bp, Homo sapiens
  ref <308>: DATABASE ACCESSION NUMBER: Contig48076
  ref <309>: DATABASE ENTRY DATE: 2001-06-18
gatgtttgtcatttttatttgcaatactttaggtccaagtttcaaactgcaatatttttacactcaagacacagtcatgcacaatccatatttcaattttctattgcttcaaccacaatttaaaataacaatattgaaaacaaaaatccttaaaaagattggatgctgaggtcagaaggatggaaccataccatcagcaggtctacaaaagaaataacttacttaaaaatcaaacaaacaaaaagaccataaatacctttaatccaaagttacagaagaatttcactacacatggtttacagataacacattctgacaaaagtaatgctcagccaaatgagatacaattctgataaacaatgaaaacgtggatccttctcaacttgttttgtgtagatg

SEQ ID NO: 2397 - DNA, 1372 bp, Homo sapiens
  ref <308>: DATABASE ACCESSION NUMBER: Contig48249
  ref <309>: DATABASE ENTRY DATE: 2001-06-18
ttggacatttcaggcctccactggcagttgctttcactgtacaaatgtaaagtgtggaaaagggtaaggacctagaaaaagttatacaaaaaatatgtgccattgtcaggtgcaaaacctggcgactactctgaaccaaattaagtataatatccttcaaaataaatgagaatatataaataagctaaaatagaatccacacaggcttcatagaaactttgaaagcattacacattggtaaggccccaggataggaagaaaataacctaacatgttcaaaagggcaaggaaaaacctccctacactgggaagtttgttactaaataaacttttctaaaatggaagcacaataatgatcagctcttggaatttttattgcttaaaggcacgtctagtatacacgaaatactcttttaacattgctggtcttttggaaacattcttagttttaaaacttgaacctttatgcactgagtgcctcagggtgaaaagaaaaacttgactttgcatttcctaagctgtaagtcagcagctttttggctcattcatacctatagatgtatgtgtacacacacacaaacacacacacacagacacatacacacccctatatccttggttagtttagcttggattaacaaaggtacaatgcccaatggctttcatctgtcttcactggaagagtcactgtaatctgagtctctgcatgggaaacatcaccattagtgttagatgctctcccgacatgcatagctacaaagggttttcttagattataatctatgtgcttgttactctcagaattaatccagcataactaaattttgggccttgaactcctttggtcacttggatctgtgccaactccaaataaaatcacaaccatttcaattattgttcagaacatttgcctcctcccttgctctggtgatacattttctgctgtctcagagctcagaatgtcagtttgtaaagcatgatttaaaactctctcagtatgtcattgtagcagtccatttttatttttactgcaggcaacatgagattccttaggggtgagcctactgcacattcaccaagactaagtggacaatagcactgtgctcacttttccctataacacatctcaattattgtgcagagacttgatcctatgtactctatgtttaaagaatgtaattctttatgtgcttgagcatcaatgtttttacatatggtcagctttttccctagaaccttggcatgtaaggcgaaagagcaacacttcctgaaacaagttctgagttgctttatattaaatagttgccctaaagcaccgtacattagacaaaggagggtggcatctgcatatttgtcattgagacaccacaaa

SEQ ID NO: 2398 - DNA, 532 bp, Homo sapiens
  ref <308>: DATABASE ACCESSION NUMBER: Contig48263
  ref <309>: DATABASE ENTRY DATE: 2001-06-18
aaaaatttttaaatgtttaatcacaagtcagtagcatgacatcattagtagagtagagtctgctgacattacaatctattgatctccccagagttaccaaaagtagttcacaatagttaggcttccttctgtccatagttcagggcatattcaaagtctctaaagctgacgtgaccatctgaatctcgatctacttccctgaatacctcaagaacagtcctttccggtaatttgggagccacctgcctaaatgcttttttgaaatcttccaaagttaaaaatccacgatagtaggtgtcaaaggctgtgaagatgtgtcttacttcgttccgatatcgttgagcttccttctttttcctgacaatatttaaaaacccctcgagtaatataccagaagtatttggatttattgaagacatcacagaatccacttctatcttggagggcttgtacccaaacagcattacaacagcagttttaaagtcctctctgctgagatatcctttgtgatcttcatcacatgctttaaata

SEQ ID NO: 2399 - DNA, 532 bp, Homo sapiens
  ref <308>: DATABASE ACCESSION NUMBER: Contig48270
  ref <309>: DATABASE ENTRY DATE: 2001-06-18
cttaataaaaaaaaataatttattgtcaacaaaggtgatatatacaacaggaaaacagatgtaaatgagaacgggagtgaatggggtgcccaggcccagcttcaggcctctgcagggttgggacaggaagaggtaatggaggcctcctggtttagaagcctgaacaagtggggaggagaggtgtcccccgaggtagtgggactcagttcaaacccccttatgaccactcttgtgtaaggcactgtgccaagggagaatggtggggagcagggggagggtgggaggaggtcatgggggacaaacagaggtgggggtcagcgaaggactggggtaggtgttctccacaggcccagtgccctactgcacaacagcctcagccaccctcgccgacctcaggcctggccaggaacagacactttccagtgccccgaaataacagtggatgctgccccagccccctcctgccctggcacctgtttctactctctccaccaggtgggtgagccaggcagctctgagttataagccactg

SEQ ID NO: 2400 - DNA, 472 bp, Homo sapiens
  ref <308>: DATABASE ACCESSION NUMBER: Contig48328
  ref <309>: DATABASE ENTRY DATE: 2001-06-18
gtacttttattgaaaaggtacatttaaaaaaatacacagacattttaccatttacaggttgcagatatagatgctctaaaagagtccactctattttgttgttctatgataactcttgcccctgatatcacaaacattccagtcttgttgatatcggcttagaaaggggggcatgggagcatgacctgcaatatattcagcgaacagaaagacaaattgttcaattataaatttttttatcttctgtacattattgcattagggagccacaaaattatgtagcatcattacaaatgaaaacaggttaaaaatgaagaagatacttatatagaaatacatggattcattgtcttcttgcagaatgcacaagaggtgcaaaaatgtgcaatttaggaagctctttttctgtttgtatacgtttgcttagcaacacaaaccagtgaggaagctacaaaataagttaaacaaaaat

SEQ ID NO: 2401 - DNA, 554 bp, Homo sapiens
  ref <308>: DATABASE ACCESSION NUMBER: Contig48518
  ref <309>: DATABASE ENTRY DATE: 2001-06-18
catttagtattttaataataataaaaaagacatacaaaatccaaacatttctttttacaattcagatacatatttttccccaagtgcaaaatactctatgaactgcatcatttgctgtttattgtcgattgtataggagatgcttactaaattggcagcagtggaaggcagatataaatacaatattttgaaatttcttctgcatttaacaaaaagcctcccacatggcgatgattattctgaaacttgagttcagctcacacagaagtataaagttttcagtttgttcaaactgctacaacctgtggtgtctaaaaaagctgatgacaactgggggttctattccttctaatcatatatttccttgtacaaataatggcacaaggatagggtgtgctacttttgagacgggtcaaatgtaaaaatatccttgtgttgttcgctcccacttttattgtgcttaagaaagaaacctggagggttaacattttctgcttatgctcagttatactttgtcttggtaccccttgtttgtggctgtaatattgaggtta

SEQ ID NO: 2402 - DNA, 469 bp, Homo sapiens
  ref <308>: DATABASE ACCESSION NUMBER: Contig48572
  ref <309>: DATABASE ENTRY DATE: 2001-06-18
ttgaatgtatatatttattataatctccaaaataatttcacttggtacaactgcttcttaaaaccatatcaatatcaggctcagaatttaattacaaccaagcaattcacaaaaacactgagcaacaaaacatgcttaatatttctttgagaaagacccttcaaatatgtgtacagcatcactgggagttacacaaaactgttacaaggtgaccattaagtgccccaattctgcacttctgacatacatgaatggctaatgtaaccacgtttgggaatctttttacatctcaaaataaagctttctgatgcaacttgccatccttttaaattttaaaggatattcttggtaattccttaggaaagtaaaactacacacactttcagagaaacaataagctgcttagatttttaaaattttttatattatacacttcaattatgggttatttattaaagacttcaaaaaa

SEQ ID NO: 2403 - DNA, 837 bp, Homo sapiens
  ref <308>: DATABASE ACCESSION NUMBER: Contig48659
  ref <309>: DATABASE ENTRY DATE: 2001-06-18
aaattttatgcatgtatacacactttattaaatttgcattctaagatatacacaaggccagcatttcacaaaacttcctattattccaaaagcagtaatcatgaaacagtgattatataagtcaatcaagcaaaaaacattatctatagggttgtatcatatcatctcttatacctgttttcaaatagaagcctgaaatatatgatatatattagaataggaagagagaattttactttataacaatcgcttttcaaatattagactttatataaaaataaaggggtcttaacaaagttcatctgtgagttagcatatctctttatttcaaaacaatccctgcaaaaacttaactttccagtccatttaaacaacaaaaactaaaaatgaagcttggtttaaataataaagtgaatcatcttgtctcctagttctcacaccattggaacaacttccatttcctgacctaattctatcccaccattgaatttcaaaaattaatgtaaataccatcatatttcagttatttcttaacagtgttaagttcgagcctaaaaatgatggccaagtgtccctttaaggcaaagaagacagtaggtggataaatatcctgaaagacaaaaccatctattatcattatagaggcagaacattttgacatgatcttttacaaacagaatagatacactgcataccatcgaagaattttttctttataatggcatactaggggacaagcttcataatagatttatgttacgtttgaagaagtagagacttttcccagatgagagcaatacaagaaataaagccattaatggctgttatggttacaat

SEQ ID NO: 2404 - DNA, 625 bp, Homo sapiens
  ref <308>: DATABASE ACCESSION NUMBER: Contig48722
  ref <309>: DATABASE ENTRY DATE: 2001-06-18
agaatttaatatatgtttatttgtgtagtaggaacattcaggtatataaataaggtaaatgctttccaacgtacagtatatcatgttcttacattgcgtggaaaaagaacctacatgtattgttcaacatggatcacgagtgcacagagagagagatcagctgcatttagtgaaacgccaagttgggaaaatggcacagcagtagcgcacaggcacacagctatctggggaggctgtggggactgtcacgtggactctacacaccgagaactgcttcaaggtcgcctgtgtctgagtgcgggtaaagtgaatatcaacacccaggctatcagggtgagacaactgaattccatcatgtccatccactttacaaaggggtgggaggcaccatggagaaactgaccagaaatgctctgccctgtcacagaggagacagagccagggcagacacagggctgacctctgggaggcacagacactggcagtgatgggtcccatgggatgcctggcactcccagcacagacagctccccaaagcaggtggggaggccctttctgtgtttgggaactttttagttaaacaaatcctcagaatcgaattaagaaggatgtccacagctcgatc

SEQ ID NO: 2405 - DNA, 465 bp, Homo sapiens
  ref <308>: DATABASE ACCESSION NUMBER: Contig48774
  ref <309>: DATABASE ENTRY DATE: 2001-06-18
cctttttggtctagaatcatagtttttgtttgagtcatctccaccatgccttccatgctgcctgtcttctcggagggggtttttggttgtaattcctttcattttgctctgctcaaatgtccttcctatttggtcaggagcccttggccccctctccacccttgggctggggcccaagccctcttgccagtcccttctctcttcaggaaataaacatggacaaactcagaggtagggtaagggcagggagtcgttcagcggagatgcttacattccggtgaggttgggtagacgaggtgccaggccccatcgtgccggggtgggaggggcggctacttcaccactgcccggacaaggcacccagaggcccctgcaatggccgagtctctgctgcctccgtcgcccagcccaacagtttcatttcccgggtgggagaagggagacaaggaaaaaagagaacgctga

SEQ ID NO: 2406 - DNA, 884 bp, Homo sapiens
  ref <308>: DATABASE ACCESSION NUMBER: Contig48776
  ref <309>: DATABASE ENTRY DATE: 2001-06-18
aatgttaacccaatactttaatatgaacgttatgatcagtaggtagtatcttagatgatacatttaatcacagacaaaacaaaaacctatctgtatatgatattaagaggagcacagaattggataaagtagggtttatcttagtcggagaccaaatggttttgatatgtggttcctagaccagcagcatcagtagcaactggaaatgtgagatgaacattctgaaacacacatctggtcaagaaccactgttttaatagctttaaccacaaaacatccacattgttccctaaagttatgctaagagtaaaacgagtaactggttaactgcccatgatacatcaatttaatggaaaattatgcaactgtcaacaagaataagcatatctatatgtattgatataaaacaatctctaatatagtgttaagtgaaataagcaatatgcagaacttaaaaatactttttagccgggcacggtggctcacgcctgtaatcccagcactgggaagccaaggcaggcagactgcttgagcccaggagttcaagaccaacctgaatgacatggtgagaccctgtctctatgaaaaacacaaaaactagctgggcattggtggtgtgcgcctgtaatcccagctactcaggaggctgagatgggaggatcacttgggcccaggaggcggaggttgcagtgagccaagactacgccacagcactccagcctgggctagagtgagaccctgtctctaaataaataaataaatctaaaaaatttaaagggggcatgtgtctgtatgtatgtatactttacacagtaacagaatatctcttaaaaaacataagaaattagtagctgaagtttcctccaggaagggaagcaggaagc

SEQ ID NO: 2407 - DNA, 453 bp, Homo sapiens
  ref <308>: DATABASE ACCESSION NUMBER: Contig48800
  ref <309>: DATABASE ENTRY DATE: 2001-06-18
gctgaaaacagaaattttgctcacgagttagttcaaatacatttatgtagctcccttatatactatcaaaggagctccaaccatctggtatgtctggaagacacttcagtgagtagaaattagaagccagcatttgaaattttctaccacagggacatgaaagcctaaaccggccttaaagggataagaggattttacatttttaaaaaataaatcaattaacattcattgtcaaataacctacaagaaagttccactagcattctgcaattgtatagaataagagaatatttgttgctaatgattacattccagaaagcaatatgtttagcagctgtttttcaaaagacttgtcaagttttactattgttatttaatccaggcataaatgtgtaaccttaaacaaaaactgtgcattattcaaccagctagtgacaaattatcttaacaaag

SEQ ID NO: 2408 - DNA, 430 bp, Homo sapiens
  ref <308>: DATABASE ACCESSION NUMBER: Contig48806
  ref <309>: DATABASE ENTRY DATE: 2001-06-18
aaaacaaacaaaacttttatggtccaaaacagtttttctcaagaatctgctctatgcaaacaataacaactttttacaaagcattttcacagaaaaggagacaagtccttccccagcgtgggaattgttcctctcgcacctcgttttcgggggaagagggggcgctattcactagtgcgggatggaaggcgcactgggtccctcagttgttcggcagctccaaaagccccagcttcccttcatacctcaacttgccatctccctaagacctaagctcccctgacctcacctgggtggaggagaaagcacttccaatcctctctgactcaagatcctcctagctggagggcatggcagagggcatgatccaggcctatctcacccctcccctggaaaacagaacctctgaccccaaacctaatcccctgga

SEQ ID NO: 2409 - DNA, 488 bp, Homo sapiens
  ref <308>: DATABASE ACCESSION NUMBER: Contig48852
  ref <309>: DATABASE ENTRY DATE: 2001-06-18
gcacatcttaatgtatttttattttctaggtggagacgtttggtaactgagaatcttttcaaggaggagaatccaaaaagccttctgctgctatctaaggctgcttagctccacagatccgtgaacagcacgcccagagtacagagaacgcggcaaaaccaacgcgaagaatccactccaggcagtctgagaaacccgggaggtggcgccacggctggagggcaggaggatggcggcgttccaaaaggcacccgctgtcacagacctcggtgtcctgctgtctgtcccagggatggagaggactgctccagggaagctgccggagcctgagtctgtcgggttcctctgcctgccccacctcttctacgggtgcctcttgctgcttctgtgtccccggccaactgaactcagtgggcttcgctgtacttggttccaaggtgctctggactccaggagagagtccgttttgccagtagactccgggcagc

SEQ ID NO: 2410 - DNA, 437 bp, Homo sapiens
  ref <308>: DATABASE ACCESSION NUMBER: Contig48900
  ref <309>: DATABASE ENTRY DATE: 2001-06-18
gaaatatataatcaggcaatctcccaagccagaatgcgtcagagagactcccaagtcctacattttcaagttaaaattcaggcagtgaaactccagagcacacaactgggccatggctgtaaaccagctatgttctgaatctcagatccatgaaaacacagaggcagcctcaccactccgcaggctgtgaacaggacggacggctggctactggccatctccctgcctgcctgttgatccactttcaacaggcctgagtctttctctgactcacccatcaggtggaccccctgcagcaggagtgttcccggccacagaaagccgattccctcatctcatcactcaatacctatctactgagtcctcctcctcagagtccagccctgcgctgggggcacagagaggagtcagctccccgctgagacagaaaccaggta

SEQ ID NO: 2411 - DNA, 540 bp, Homo sapiens
  ref <308>: DATABASE ACCESSION NUMBER: Contig48913
  ref <309>: DATABASE ENTRY DATE: 2001-06-18
tgcagtttaatgtttaatgcccaattatctcaatacaaggaggcttacatggtgctcataaagacacgaccaggcgaaaccaggccggcaggaaatgacccgcatgagtcccagcacggggaccatgttctctcggttccagctcaccctcgaaaagtgccacaggcaaggttcttcagctcacccaggagccagcaggctggccaggcgtgtggccaccatggtcactgaggatcctcgtgggagaatagggttctgggacctcaggatacaatcacaagaaccagaaagctgcttccaaacaaccccagaaggttttcacttcacatgcgctaagccacacaacacctggatgctggggcacccaaaccctttccctaaaactctgaacactgcagaatggaggttgagaacacttggggagggagaacaaagtcagaaccatcctaaagccagtttttcaagcttgaccacctccctcttcctccctgaaggcacaccagccgatcccattactgtggaaaagggacaccctctggt

SEQ ID NO: 2412 - DNA, 710 bp, Homo sapiens
  ref <308>: DATABASE ACCESSION NUMBER: Contig48945
  ref <309>: DATABASE ENTRY DATE: 2001-06-18
cactctaaagatactttttatttaaatattttatgatgatacatatacaaatataatcttccaaaaaacaaatgtaaaactaatacaaatcactttttcaggaacaaagaaaatcatttagaaaatgtgattatgctaaaagaggcaggttaggtttccaaggctgctcaaggtggaagcttaagaccaacttttgtttgagtacacaagtgatatttacattttcatatactagtgatatacctgttgcatacttggcaaaataaaactgatagtaagtctataataataaaagaaacaacaattactaagtaaacaattctagatgatggaagagtaacctccatttaagctacagacttagatgtctaaaaatatgtgtcctgatctgtacagttagtgggagcacactatataaatcctttgcatgacaccattcaacaatattttttaaaatctacaaaattttaaagtttcacatccctagcaaaatatcttcagtcaagaaattagtctttgaaaattatgaaaattgttgtgggaaatatttatacaaattattactgataatgcacatatattttgaaacattgtttctagaagcaataaaatataacctatttaggagataacccaaatgatttgtaaaaaaattaacttgtagaaaagggaaggatgttgtgtaaaatcaagtcaattatttgaggttt

SEQ ID NO: 2413 - DNA, 570 bp, Homo sapiens
  ref <308>: DATABASE ACCESSION NUMBER: Contig48970
  ref <309>: DATABASE ENTRY DATE: 2001-06-18
ataataattttgaaatgtttatttcaaagagcgttggtaatttaaacgtcctatttaatccccaaaacagtcctgagggggagataaggcagttatcttcatagtacaggaaaggaaaaaagcgagggtccaaggccgactataccctcagctccattagcccccgaggcctccctgacaggcggggcggacaatcccagtgcagatgctctgtatcgatcgcatgctatcggttctttcaaggaacgtgtattgatcatcaattaagtggtgagtactcctctagatgtcgattcttagcaaactgcggaaactcctacagacaaaaactcaggtgtgggcgcagaagggccggggatgcgctcggtcaagacttgaaggtccggggcttgggccctgtgtcctcaccgagccccggggaggctccggctccgtccacacccggagcgcgactcagccgcggccggggctcttctggagaacggcgcggtcaggctctgccgcagctttcaggtcccctcggcccgtccgggtgcagcgcaaccaggctgcccgcggagccccaccgcc

SEQ ID NO: 2414 - DNA, 754 bp, Homo sapiens
  ref <308>: DATABASE ACCESSION NUMBER: Contig49058
  ref <309>: DATABASE ENTRY DATE: 2001-06-18
taatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttgataggtggcccctctaaattgcagtagcgaattttacaacacttgaggtaaaagaagggcatgggctcttccaggagaaaccgcttctcctctggcttgggtctctccatcgctgcacaaccagcggagcactgcttcgcaaccatgaaaaaacgtggaaatattttcacggccgctataacgcagtatggctctgtccatttgcacctccttgggttctggcactcgaaagtgttttctctctcacaaacatgacaccacactctattgtcaccctcgtccgttcgctgggagtcctctggatctcgttgtctcgcagtcaggttggcgtctgtccacacccgcggtagggccacgaccagcagcaaggcgagcagcgccatcgtccccagcggtgcccagggagggtcagcgcgcggcgccccctccccgcccttctggaaccttcgcagcctccgcgcgcctctccctgggtctggccggtagggggagccccgcccgccccggggcgcgcgcctcccacccgccggggcctgtcggggtcttt

SEQ ID NO: 2415 - DNA, 395 bp, Homo sapiens
  ref <308>: DATABASE ACCESSION NUMBER: Contig49063
  ref <309>: DATABASE ENTRY DATE: 2001-06-18
aaacagagctctcttcacatttattaattcctgggaggaatgagggaggcttctccagccccccagagaccccggccttgtgctgcaacaggaggggagggagccagtccagaatccccggcacttctgaggacaccaacagcaccctgggcccgcggctgcatcagctttctgccaccaggagctccacagggtcgctgagctccgattcgaaggtgtggggcacccaggagcggtagcggcacctgtagttgccggcgtgctggggccccacgaagatcagctcgaggttcgccgcggccccgggggtgcggaccgtcttcacggccttcgtctcgccctcgcgcagcagctcgaaggtgacgtcggggatgggtccctcgcagcgcaggacg

SEQ ID NO: 2416 - DNA, 777 bp, Homo sapiens
  ref <308>: DATABASE ACCESSION NUMBER: Contig49093
  ref <309>: DATABASE ENTRY DATE: 2001-06-18
ctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgccaaaaaaaaagaaaacagaaagaaaaaatgtatcatctaaaggactagacacagaacaattggaagtcaacttcaaacact

SEQ ID NO: 2417 - DNA, 511 bp, Homo sapiens
  ref <308>: DATABASE ACCESSION NUMBER: Contig49098
  ref <309>: DATABASE ENTRY DATE: 2001-06-18
gcaaccacccatcaataaactttcttttttattattaagtgggggcagggtttctgttcttgcaactgagtcctaacagaaaacaatggtttcgctgaccacacggagagctgaggacaggacaaaaaggcatgagacagctggacacctggagagaggtgacacaggacagagtcctcacccggctgccctgggcctcggggagctcaggctgcagtccctgggcctggtggcacccacagcacggcagtctctggctgggcttcggggagcccacatgtctgatcggcagggcttggctggccaggcggtgggcaccagcgtggtgggtgggcagtcctgggcttccaggaggcctcctgggactcaggctcttcagtggggtgtgcctgtcagggtgcaggtgggttctgtggctacactcccatcctgtcttccctctgtgttcccaaacctgctctggtccctagatgtctggagacctggggtcgtccagctcaggaggccatct

SEQ ID NO: 2418 - DNA, 534 bp, Homo sapiens
  ref <308>: DATABASE ACCESSION NUMBER: Contig49169
  ref <309>: DATABASE ENTRY DATE: 2001-06-18
aatttttacatttaattttataccttaaatttctttatcattgaggtgccaatgttttaatggaaaagtagaaaacagtataaaattcagtatcacctatttgtctcaaatacaagtacagtgagtattaaacaggaatgacaatagagtagcaaaaacagaactgtagatttgcccaaattaactgtttctccgaatttgaggtgtatggcaagttgaatctttgatctctcagcagttgttaattacattatcagcttaacgctttcaaacactacgggaggcatttctctgttcacatagacttaagtacacatatactaagctgtaaatagtctgccttccattagtttggtctctaagcactataaatatgtcgacttcatatcagtctatgagacccagtgacccccttttcagaggcatcggtaatacatttggcaaatgtcttgaaacatgaattgtaaattaacataggtagaaccttgataataagagtcccaaatatgtatttttaaaaatgttaacattagg

SEQ ID NO: 2419 - DNA, 613 bp, Homo sapiens
  ref <308>: DATABASE ACCESSION NUMBER: Contig49233
  ref <309>: DATABASE ENTRY DATE: 2001-06-18
taaaacacaattactttattgatttcttacaataaaatactgccaactagcattacgtccactcttgcatcattaaaaacaaagggtatttcctccttggtattttcaaatgatgcattatacaataaacgaagttagaacttaaaatgcaccctgattaattatgtaaactggtaatttgttttaaaaagcataataatttggttcctttcttcataaaatggaaatttaaatatttcttctgatagtcttgaggttatcatgagtagtgcaaagtgtggcacatatagtttcatctagaagggtgtgtatcttacacaccttaaacaaacagaatgtgcattaacaaaatgcatacagtcaatgcatgatagaaagcatgtttcaaatataaggcagcccctccggcgaccatattatttaggttttgcattatcatttatggcattatagattaattacacataacttttatacattttaaccctgaagataagaaaaataactgttgcttgaaagaaattcttccaggtagccatttggtttgtatcaggagaaaccgaacctccatgagtttagcgtctgccaagtcggaatcattagctgaagtgag

SEQ ID NO: 2420 - DNA, 907 bp, Homo sapiens
  ref <308>: DATABASE ACCESSION NUMBER: Contig49270
  ref <309>: DATABASE ENTRY DATE: 2001-06-18
ttatttttataacattttatataactcataaaacagtgtttgtataaaaattcacacaaagttgctagagagcatacaatttccaaaaatgtcctgggtttttgttacattcagtttcctaaggatgcactccaatctatggtaaaatgcagacatgatgcgagatttcattatctttggtaaaactattctcattattttgtctcctcacagtattaagtctgatatccactttgtgcagggtctgctattactaggatgtcagaaaaacattaaggctggatctacgagaggcaagtatttcccaacagcagtaatagccccttggccctcacccccacttcatgtatctatacagtcgatctacacagccaggcggggtgcaagctcacgacctccactcgggagtctcgagatcccctcttgactgggaaagaagcaaacatttgtggggaacgttggaaacggaggccatctctaaatgaacccagtggtcatgctgtggtgtggtcagaccagcaacttttaccaattaaatagccaatctattcaccactaagtagatcccattggttggttggttgatgattgctgctgatgtggttccccactccccacaaacataaaaggaaaggaaggtttggagccaacaccgaaaggggaggggcacgtagcgcaaatgacaccagacacgactttattccctgtcaaacatttgttgtcctgtagacacagccaaggtgaactgaagggggatgcgaacactcagtacattcgtgactatcttcatacattctttaaaaacttacagagaaatcaatgaagactaccacctactgtgacttactagttcattcaacatcaaaacgtgtctgtgctaatcttttagtccttgggatacaaggcc

SEQ ID NO: 2421 - DNA, 481 bp, Homo sapiens
  ref <308>: DATABASE ACCESSION NUMBER: Contig49282
  ref <309>: DATABASE ENTRY DATE: 2001-06-18
ctgctaatatccaaagtttatcatagctatgacaatatcagtcccaaccaggttacaagtttgttacaaattacaaactacttaaaaacagttttgaaaaaaaatatatcccaaatattaacactaaacactaccctggagttagaaaaactgtaaatgggatgaggaaactgaggtaccagtggtgacataaggcctttttgtctgacagactgttttctgaagtcagtgtaggatgtagtctaacagacctccagaagaataattcttccaactaccaaatcagcacactgagacattaaaatactcaaatcagaataaggaccgaccctaagtttaaatgtgtatttggattaacatttttcagcaggagtgtatgaagaggggagaggatacaagtcaaagactgggtagtcaggccccctgtcccttgcagaatcccttacactcaccaaacagaatattaaagcaagagctaccc

SEQ ID NO: 2422 - DNA, 458 bp, Homo sapiens
  ref <308>: DATABASE ACCESSION NUMBER: Contig49289
  ref <309>: DATABASE ENTRY DATE: 2001-06-18
aatattgaaaaaatacaattaaatttttattaaaaatacatactccttacgcgatctttgtgtacattttgtgtgaaaaggaaaaaaaaataggaaaggcattaagactacctaattatttatactgtatttggtagaagcgtgtttcagtcaaactttaacgaaaaataagttattctgttttcatttgctcccggacgtcagaaggcagagtttcaaacagagcatcttctacaactaaaccagctcgcttcagagcccgacagtcacccagttcaggagggaggatttcaaagtgattaccttttacatctaagtaggaaagaaatagcaaatttccaattttcggtgaaagtacagataggctgttttttccaatcttcagagttttaagtttcttgcagaagtagagttcatctggaaggctttccactttgttacatgtgatggaaaaatac

SEQ ID NO: 2423 - DNA, 532 bp, Homo sapiens
  ref <308>: DATABASE ACCESSION NUMBER: Contig49342
  ref <309>: DATABASE ENTRY DATE: 2001-06-18
ccttgaccaatgccagaaaacctttatttccaccgagacctctcatccaattctcttctttccgggaactttttcccttccctactccaggtcgtaccctggccactcctttccttttggctggccaatgtctcctctgtaggctccagaaggctctcagggatgcaggcggcctcctgcagggttgagttgcaatgggaacaaagacagctgtggtcccatagcaccctcatctggtgacatcctgctactgacagtcaaaagaagccttcccagatgaaattttagtcctctgcgcagccatgctcttcttccagcaaaagagccatgtgcagtcgggtctgctccccatgggggctttgatgtgggcccagcagtggatcagccttccagacacgctcaactctgcacactcttcctgccgcctcaggctttccaggaccctcccgagccttatcagagtccttaccctcagggctactgataccttgctgggtgaccttggacagattcacttacctggactcagttt

SEQ ID NO: 2424 - DNA, 461 bp, Homo sapiens
  ref <308>: DATABASE ACCESSION NUMBER: Contig49344
  ref <309>: DATABASE ENTRY DATE: 2001-06-18
accagcgttccagacatttgcgataagtttaagcagataaccaaagggagtttcgtgatggagtgtcacacgtttatgcagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcgctacactttagttgtgaattttttaaaagagcagtttaaaatcaggtcattctaccagcttttgatgattagctatgaagtcatactttttaaagaaaacttatttttacctgagagatcaataatatataaaatgttgagtgtgggtttgtatctaataaagtatgccaacacctg

SEQ ID NO: 2425 - DNA, 602 bp, Homo sapiens
  ref <308>: DATABASE ACCESSION NUMBER: Contig49388
  ref <309>: DATABASE ENTRY DATE: 2001-06-18
ctggttttcttttatttagtgaaacattcctttgtaagtgaatcttcaatgaagacgtcccgagtgtgtgtgggggcggagggggccggcaggggaggaaagcgagcaaactgcgctcatccccctcccccggggcctgctcactcctcccaactggtccgggcctcctggcctccctcccgcggcctcccagccaatcattcttccaggccccggcccaagtcccaacttgctcaagagctcaacctcctcggggagaagcaggggtgggaaaattcgggtgacccagagactggggaaggcaggggctgagacccgatcgccccgcccccgagtcacggccaacccagcaccggggacgtgtaccacaactgcagcctcccaggggagcctggggtggttgcggggagggaaggaagcgtccctgtgaagctgcagggaggggtggggtcttatttgccccccgcgctgctttaggggaggaggtgcgaaggcaaacactgacaggacggggaattttgaatgctgttcttctaaaccctaggaaggctcagggcacagcaagatagtctcagttggctgcagagacccctccactgaca

SEQ ID NO: 2426 - DNA, 605 bp, Homo sapiens
  ref <308>: DATABASE ACCESSION NUMBER: Contig49405
  ref <309>: DATABASE ENTRY DATE: 2001-06-18
gaacctttttttttcaggtataaacattcattcaatccaataaagacattttagaaaaaagtcaacctatacaatttattttatttttcctataccttggctaaacaaaatatatttggtgatactgtaaaatactaagcattttcagtaaaactggcaatcaaatacagcttaaccttcttctgcgtgacaactgaggattttaattggaaaagtattatagtctataaacaggaatacccaaaacatatttaaaccactcgagcactttgatttttccatgttctttgcatctagattgaaacacatcacaggaaatttcaaagaccaacggctgaatatttttcatttcaacatttccagtggcatcctacaagagaactagcactcacaatgagtcatctgaattttctttaaatcgtaactcatttttaatttctaaacaggttttacctccttatcttcagaatctcctccttccaatagccagtacagtagctccattatgaattgcagactttgcagaccagccttgggatgaatttcagccaacatttggaggaaccccttagttcagaagtgaacttagctgacagcatccaaat

SEQ ID NO: 2427 - DNA, 623 bp, Homo sapiens
  ref <308>: DATABASE ACCESSION NUMBER: Contig49445
  ref <309>: DATABASE ENTRY DATE: 2001-06-18
ataactaaagcgtttatttccattcaattcactaactgattgctctgcttgggtgtctgtgttggttcacaggagggagtctgtggccagatccctagactgagggcgtccccatggccaagacctttaggcccagcaaaggtctggtggggggaaggaggtgggagagaaatcacacactttctctccagggaagggaagaggcatgcttgcccgtgtctctgagcgcaccctctggagggcagggtatcacagtgaatgatccgggtcctggcctccgatgcagcctggtttaggctcccagagggaaaactgggttttgaccatctgagggcactcaggagcctcaaaggggcctatttgcctgggaagtactagatagattggggcaggagagtgggaagtgggcaaggacttccagccctgcagcctcagagcccacttcctcctcaatctgtccctttcatcaacagtcctggagtgggaagctcctccaccttggcgcctccccctccacacccaaatctcactccagtctctgaatggcccagatggccccatggcagtgggctttggtgaggcctggtggcaggtgggaggagggaagagtgtcaatgaaaacc

SEQ ID NO: 2428 - DNA, 553 bp, Homo sapiens
  ref <308>: DATABASE ACCESSION NUMBER: Contig49468
  ref <309>: DATABASE ENTRY DATE: 2001-06-18
cttatgataaaaactttattgtcttaaatatcaaatgttttacacaccactttttcttcagaaagttcctatttaaaaaaagaaaaataaaataaagtgttttgattatttagggctgacttacatttcagtatgtgacaaaaattcaaacccaaatgcatctagctcactcagtttcagacaggtcctatgttcagcccctaaacgaatggcacaatgccaccaattttgggattcctgagtttggttcccttaagttctcagagttttcccaactctcaaaaccaaagcatcatgggagtgacagggccactggcaagactttttgccagtcagcctagttcttcttttaagatgcagtagtctcaaagcttaaagtcagaaaatcttgcaatacaagagtaactgcaagaacatataaagaaggaaaagaaaggacggggtttctagttgctaagatttgccaaacatggctacaaaactggtaaacaaacctttcttgagtgcaaagtccattagcccaacttgccatgaagagatttgaaataaaaat

SEQ ID NO: 2429 - DNA, 1372 bp, Homo sapiens
  ref <308>: DATABASE ACCESSION NUMBER: Contig49509
  ref <309>: DATABASE ENTRY DATE: 2001-06-18
ctgatgtggtggtaactttttgagggataatgaaattatgttcagcctcaaaaccctgaaaattaattataatgctgctcagtcttgcttatgcatttgtttgctctaacatgctctttccattaaaaattgttaacttcctccattgctgttaaaaaaattaaaaagggatggaaaaaagagagagacaaaaaagatgaaaaaaaaaaaaaaagaaaggaaaaggcaaaagcacttccctgggggaaaaactgtcagatagaccgatagtgttattgttgcatggttattttaataaaagtattcttatatgttatattattaacaataatttaattaaaaacccaaaatactctattgtttcatttctcttttaatatttctctctctcctctaagaaaatgttgcaggaagtttggatcctcttggtttccagcaaaacaagagaataaaacttccatgcaacccgatggcaatacgaaaaaggagttcatattgtttgcagtgacacaagaatctacaaaacacctatattataggtcattcttttcattatactatagttaagttacagactgctacaaaaggacatgccagcgtgaagaggttgaggaaggggtcagaatgaacagaagagtgcacttattctgaggcctgaaaatgagcactgcagttatcctttagttccagcggaatgaaatatgccgagggcggtcaccctataccttcaccaggggcttgtggaattccctgccagcacgagaatggatagcagcccagcaatattcacagtaatactgcagacaggtaacattagcacagaaaaatggagcaaatttccccccacaacgggccccctgacattcatcacacagctgatcatccaagacatatggcttaacttccacccgtttatctatctctccatgctgcagctgaacaaagcgggcactgatagcagctatgtaactctgttgattagagaacgcaactctcccagctccttttgggtattttagctcagggtcggtatcaatcccagcgtaacacacacctccatatagccgatccattatcatcgcaagctccacagctcgtaatggtcgaggaacaccaccaacaaatatagtttttcgtgggtcaagtggctgtgaaccatccatcacaaagtcactgtcactgagattccaaggccgaatctggactggcttatccttgatagtgggacttgatacacaaaggtagagttttccatcttcttcaatgcatgcatcaatgagagcctgcacagagctttcatcttgaaacagcaggaatgcatagcctttaggaggaaaataggatttgctctcagctttatgaggccaatcca

SEQ ID NO: 2430 - DNA, 476 bp, Homo sapiens
  ref <308>: DATABASE ACCESSION NUMBER: Contig49510
  ref <309>: DATABASE ENTRY DATE: 2001-06-18
gatataacaaaacctttattctcagaaaacaggaaaaacaaaattaaaaaacaaaaccaataatttctatctggcccctgccccagccctcccacccacccacatatcctccttttggggggaccatgatgcatgcatagggatgggagctgaaggaaactgtgttccttgggcagaaaaaagtccttgggtctaggtgttctcctccaagttgatatccctcccagccttgcccaccctccagacacaccaagaaggaggaattctggagcagtgccagaaggactgccctgaagctccttggggaataggcggctgagtcagcaccacccccatggttttcaccagttacagctcatcttcatccagcttggcaagtctggcttggcagggaggggtttttggagttggagagactggaggagagtcatggggagcctgggggatgtcaccaagggcctgtttatccagtggca

SEQ ID NO: 2431 - DNA, 943 bp, Homo sapiens
  ref <308>: DATABASE ACCESSION NUMBER: Contig49578
  ref <309>: DATABASE ENTRY DATE: 2001-06-18
tagggaacaaatttattttgatttttctgaaaatatcaggaactatgaaaaaacaagctcgatttctggccgtaccaaaagcaaaatacaagtaaaaataacatttgaaaaccaagtttaacctcagagaatcatgttttaaaatacaaagtttaacattctttcctctatggagctaaacaagttttctaaaccataagactgcagtttttttatttttttaactgacgtaattttttaaaagaaaaaacaaaaggggaataaacagcacttcctaccctggaatctcgtcatttataaaataacatgctcaaatgtcagtgaaaataaacagttgataaacctgaaaacaagtcttttaatgagttcaggttacaaccgaacacaggattttgtaactgggaaagaacagcttgtgtaacaaccgattcttaccaaatacaaataaatataaaagacaacttaaaaacaaactgtataatcaaaatctttccgtaaaatagcagctttcacaaagtaaaaacaatttagttccacagagttgtatgctctgtaggcatatggccaattttcttccgagtccttttgtcttgcactatcaaaatagaatctttgtcttggagcaagtctgctgaagaaggcaccaaaatcctatcctccctattcccctaactgatattaataatcctcttatcaatcattgcaaggtaacttcaatgtcattaagtattaacattctaaatatgtaaagctatagaaggaaggtcctgcctattctctttgcccctctcaaatcattctagtctggtttaccaaacagaaccaccagctaggaggataaaaatacattcccatgttcactagccattaaatgaacatagccacttgtgcaggaagcctaacatttttaggatttcctaactttttaaaacttaaggataag

SEQ ID NO: 2432 - DNA, 860 bp, Homo sapiens
  ref <308>: DATABASE ACCESSION NUMBER: Contig49581
  ref <309>: DATABASE ENTRY DATE: 2001-06-18
ttttttaatttttcagttgtttattggaaactatagattttttttaaactcactaattattttgccatacaagagcaaaattcaagtaatacaaatatttaacattttggtataaaattaacaatatggaaaaaagatgcaaaccaaccaaaaggtaaaaaaattttaacaataacactgtgtataaccatcttctattcaagtgaccatccaagctgatagtttattttccctttgttgacattttttaaaaagatagccctacactggagcaccaaaaagttttttccttcttttttaaaaggttggaacccttttatttacagatactcttctcagtactttaagtaagtgtgatgaaggaatcatctagcaacttccttcttagaaaaaaaggaagtgccttcatatttccttgaaatttaaacttgttccattctattctaagcaaaaattaaaaggacacagttcagaagagctctttcagcaaataaataattgtttcacaaaagcactgctgtaaacaagatcactttgatggccagagacacttatgttttcaaccaatggcaaccttaaacacttccaagtatagatacacagggtatatatgggcaaaaggcaatacatcattaatcaatcaactaataaaaattaattataagcttgttgcttggtcaaatatgcttttgttctctatgtttttttaattggtcagaaaacttaaactgtaatgatctaaaaccctgtatctactctgaaagtaactacaacctagaatgtttgacactgtagttttgacattagttaaaaattctaaattatctaagcaatgtaaacaagcctcaaatttcaaaata

SEQ ID NO: 2433 - DNA, 487 bp, Homo sapiens
  ref <308>: DATABASE ACCESSION NUMBER: Contig49631
  ref <309>: DATABASE ENTRY DATE: 2001-06-18
atcaatcatatcataccaaagtttattgattacatcaaacaaaaatttctgtaatggaaaaggcaagttgcagtcataaaagatggcattcacattcattttagaaagcaacaacgtagatgtaaaaaactgcttaagtgaaaaatgtaatattgcagtcccattttgcaagctgaaaaatgattttgtcaacacgcataaaatctgcacatttatatactgcatgttattaaaaaattccatcactaaattattacgaattttgcaaagttaggcttacatttatactgttgctggtgtatgtgtaagtagatatggaatgaatgttttcagtttagtaggtaacatcctcaaacaatggacagcggttgtgaaaattacaaagacattttgatagctcaaaattattcaaattataggtagatgatcttattatatttttttccctttctctgtcacaaatagggtgattacattgagtgctagg

SEQ ID NO: 2434 - DNA, 481 bp, Homo sapiens
  ref <308>: DATABASE ACCESSION NUMBER: Contig49670
  ref <309>: DATABASE ENTRY DATE: 2001-06-18
attatagtaaatttattttgtataaatacatattaacattatttacaatgctaatttttttatttataaagtatctttatatggacaaaaagatacaaactgttatcattttaagtacaaagtatttctagaaatacattataagccattaaaaaaaaaaacgatatttcaagattggttcttacatgctatgaccaactcatatgaaagagcaagttgctcccccttcattccttcccccaactccaaagggaaaggaatttgatatttaggctttaaaaaatttcctactacctttatcttttaaaaaaccctactcaaaacaactatctcttataagggaaaatatcatagataagattttcctttagaaaatgacattaaaagtggcatgagccctagaatgatatgtgtattagaggcacttaaaaaaaatcagaagggatccataggaaggaatttaattcagcaaatactgagt

SEQ ID NO: 2435 - DNA, 1176 bp, Homo sapiens
  ref <308>: DATABASE ACCESSION NUMBER: Contig49673
  ref <309>: DATABASE ENTRY DATE: 2001-06-18
aattgtaaaaaactttatgaactgagaggtcctaactccaaaaagaacattaaagacgaagtgtaagagcattacaaatgatcgccaatacacacaaaggcagagttgcagtgaaaatcaacagccagctgaactgtgggtgaaattccctttatataaacatggccttataatcagatgacctcagatgggtctctggtgtgtacaaagaaagcaaaaccaattttcccatgagtgcctctggacactcatgtaagagttacagatgttgactacatttaaacatttatcatgcttccaaaaacatatttgtaagagaaaaaaatataaaaataaaaatgtacaaagttctttattaaaataatagcttaaataaatcctctgtcaacaccagacagagtcagtgactggatctagactctagagcttagagctttttacatagttacatgaaaacatttgaatccgtcttcacagacagtgccacgatgacaatctggttaaaaccaataagccatcttccagatgcagcttaagagttcaggcgagaaaaggaactgaggaaaatgactgtacataatatggttctcattctatttgccttttttcgtcttggctgtcttctcctttctttttttcacatgtttaggaattttgttttttcttttctctctctgggcttccttgaccatctttttttctttcttttttatcaatgtcagggtccgtggtgtgtttcttggggcgggcatggtctccctgctcttcagagtctgtgtcagagcactcagagcttccaatatcttctgaatcagaacaagtcctttcctccacttgattttctaggagtgcagggaccttctgaactcctgacaaatctttcttcaatcctgtaacagtctggtatagaatattatcttgttgggcattcatggccatgtcctcttccttcaatttcataattatgtccatatccctctcataatttttcacttcattcaaggttctaggaatatatgctcgcttaaacacctcttcatccacatgatcttggctagaccgttcttccttggtcctttgagatgctatttccatggcctttgagagataagcatccatgttctcatgtgtaatggatggatctgtgacaaattcaaagatctcccgcacagtcat

SEQ ID NO: 2436 - DNA, 588 bp, Homo sapiens
  ref <308>: DATABASE ACCESSION NUMBER: Contig49743
  ref <309>: DATABASE ENTRY DATE: 2001-06-18
catctcacttcattcaccattatttgttaattttattttgatttttaaaaggcattattcagtgtacaattaacaaagaaatcagttttctactctactgtacttaggatgcttcaaaaacatcaggtgaaatgatctatgctttaagagccagaaaactcaggcctcagcaactaaaacagagaattccaaaattgtaattacaaatcagatggtaagcctaatttcatgcccctaatattcagatttgtggacactgcaagaggaaatatcatttgcttccaaatatctggcttgaatattgctgcagttaaaggatctcgctaaggttaaacaacaaacccaaaccacttagagcttcacagtttagctgctttagcaagtgaagaggtagtcggtattcaggatgctgtgggaatgcaaatgatttgattttgaggcatggctgttcctttttcactatgcccctcactctgaacaagctcatgctttcactcaatcaaaacctacttatcacagccattctccaggttccgaacctccgtatggcagatcaaagtccataatcatttctatttataaatgcca

SEQ ID NO: 2437 - DNA, 542 bp, Homo sapiens
  ref <308>: DATABASE ACCESSION NUMBER: Contig49790
  ref <309>: DATABASE ENTRY DATE: 2001-06-18
aaaatcatttattattatcaggagtgccttttaggtggaccgctctgtatgactctcatgcttcaaaactattttttattcaagtgacttacaatggccctaggaaacaagttctgttattatcccccattttaaaatgatgaaaatggacaaagcaaaagcaagcaacttaaccaataccccatggcctcacagcctttagaatagtcatattatataaatatggcaataacaatgcactgaaaatgtctccaaaacaaactctacattttaaaaaatgtataacaggaatctaaggaaggggtcttacttctctgattcagggagtgcgaaatcccttaaactcatatcagacctgtgatgaacaaactcacactaagttttaaaaactgcttaatttactttatcatgactagtaatatataagaattttgtatatactttattaaaaataactttggaaaactatttttgcctgatcagcaataaaactactgataagataagctggttatcaaataattccctagtgttaatctggc

SEQ ID NO: 2438 - DNA, 1056 bp, Homo sapiens
  ref <308>: DATABASE ACCESSION NUMBER: Contig49818
  ref <309>: DATABASE ENTRY DATE: 2001-06-18
attctaagtataatttttattaataaaaagattaaccatggccatgtaaaatgagtggctgggcttagagtttgctacaccaatgaaattaaaaaattaatacttgagaatgttaacaataatttataatagcattccttgatagaggcattttaattttagcaattatttctcttaaatatataaactaatccttagtgtcatggaggagaatcatcatagctactgatcaatcaaaaaagaatttctgagagctgtttggtggtgttatctcaagacatacaaccaagctgtaggaaaatctcccaaaaaagatctggaaaactgtccagtcacaacacaggaagaatatcactgtttgacacttgtggcaggggaatatcccacttgcaagtcaagcgtgaagaataaacacaaattaagaatgtacccaagatccccaaataaattagtaaaagtgccattaagaattatcagacatagaatgtgtttcaaatacacatttgttaaatccaaaagatacagtaattttattacataaaatttctcctgtgtgctaaaaatgctaacttacaagacataatatttgtagtagagggaatcacggtcggctcgttgaattctttttcattattgaagaatagaacaataggtagtggacatagaagcactcagagtcctctgaaattcaaggttgttacattatgttccaccaaaataagactaccattctctaataatataaatgcctgttcatttcacctttcaaaaataaagtccatttcttctccattaaagtttctgcaagactgacaaaggtacattctacctattaaaaataggagcactcttcatctttggataatgtatcaccgcttagggaaaatgtattcatatacagatttttatttgaggcagctgttggagttcattaagcactttttgaacgctgtacctttaaaaatttgtctttcatatagctttggaaaaccaaaaatagaagaaaaatatctatggtaaagtatatttcattctgatttgatagcagtaaaatac

SEQ ID NO: 2439 - DNA, 787 bp, Homo sapiens
  ref <308>: DATABASE ACCESSION NUMBER: Contig49849
  ref <309>: DATABASE ENTRY DATE: 2001-06-18
agccacaaaacattttatttacaaaatatatactgaatactatacatctggccccatcaccatggaaacaactccaaagcctgcctggggatttgtgcccaagcccagcccaggagggctagagaaagcaaaggtgtctaccagccgccgccatcccagaaggaaagcctcttcccatgagtgcctgtgggtgggcggtgagctcaacacccacaaagggcagaaggcctgggggcagtgaggtgatggtgagggcatgggaagcagatgctgctgagggtgggtggagggagaaatggagacccagcacccagcagggggagccaggtgacagcaggggaagcagatggcagggccccaggcagtccaggaccccaggctctgaagggtggggcaagggggtcaggtcacgtcttgacatccagcagtggcatccgcttgtgctggtagccactctgccagccatgtaccaccttggggtctcccatgtcagagagcagctcctgctcagcctcatgcagttcctcagctgggtcatagctgtacatggggagcaggtgcatggcgcagccggtccacccgctttttcttctgtacatacattaccacagccaccaccaccccgaccagggtgatgaggaagaagggccccaacacatagcccaccatggagtcgctgttggcctggggggcattgggcacagtggtgttactcatgacatcagcagccggagggctgggtggtcagcatgggcagtggcgcttcgggagggcgcctccactgggc

SEQ ID NO: 2440 - DNA, 1052 bp, Homo sapiens
  ref <308>: DATABASE ACCESSION NUMBER: Contig49855
  ref <309>: DATABASE ENTRY DATE: 2001-06-18
gccgggacttgaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactc

SEQ ID NO: 2441 - DNA, 505 bp, Homo sapiens
  ref <308>: DATABASE ACCESSION NUMBER: Contig49910
  ref <309>: DATABASE ENTRY DATE: 2001-06-18
gtgagcatgaattatttcttgttttattgctttcttgtttctttcttgatgcagagtcaatgtttttgagtaacagtaataagatgcccaaaatccaacagtaaacattcaaatagtaagatctgatgcagaacaaagtcctcaaatgttaactcctataagttacatctagcggaaccacgagggataaaggctgaactcatcatcttggtttatgatggaaaccgctatcctctgacccagggaacaggaggaagtctcgaatgccagccacctgtttaggcactggtggcagcactgtggtctcctcgtgaaatggccggggagactcacagtgagtctaagtatggcaatctctccttttaccccaggattaagagatgccccccgcaactgagagaatcaaaagaaactcctatggaatagaagacgtggttacagtgataaagatcagaaatgattgtgttgtcaaggaagtgacctgtgactgcacagaaccccatct

SEQ ID NO: 2442 - DNA, 540 bp, Homo sapiens
  ref <308>: DATABASE ACCESSION NUMBER: Contig49948
  ref <309>: DATABASE ENTRY DATE: 2001-06-18
aattttcatatttcattttttattagttttgttttttttttctggtagacagtacacttgggaattatactgcaccaggcataaagagtaagttttctaccacagggacattttgtattcagaattcaatataaatatttctagtcagacatttccatggctacagatatttggttccttgatttatatgcatagaaagaaacagttgtcataactgtaaaaagcagtacttaataagtacttttaaatgattggaacagttttcctttaatattacaatactacttatttattggtttggaaactaggtcaccctacatgatgttttgatttttctcaaaggcatcatgagtactctgcttattctttcattcttgtatttttagccttctagttgagttagggaccattttatcagaaatcattttagcactgtaataagaaaagctctgttaagggtagattatataccataatgattttcagacttctttttataaaaaaggtatctggagactctgaacaggcacatgcatactc

SEQ ID NO: 2443 - DNA, 656 bp, Homo sapiens
  ref <308>: DATABASE ACCESSION NUMBER: Contig50004
  ref <309>: DATABASE ENTRY DATE: 2001-06-18
gaagagataaaacttagctttactaagttaaatcagaagagaaaaagacagatctagaagatactatttccaaaacatgtattctataaactgaaacggaaatgcaagtggccagctttcttttattctttcaccggccaagggggagcaacgttttgtgcagggccacttcaccaccaaggactctgaccgcttctccacctccaggacaagcactgaggccaattccacctccaatctgctggtcttccacattcacacagggccatttcaccaccgactcctactgcttctctgcctccaagaggagcactgaggccaatttcgcctcgattctgaatgtctcccactttggtgtagagccatttcaccacagaggactctgaccacttctccacctccaggatgagcactgaggccgatatcacctccattctggtggcctcacacagcaactcgctgctgaacccagacatctttgctgaagtcagttgactggacagtacagtgcaggatctgcgtgtggcacagggaaacgcaagccagctccagtaccagcaggtgtgcgcgaggtacaagatgctctgcgtggtgcccccaacccactcctgtacacctggcaggtggacaaaacgctcgacctgggcagcatctcc

SEQ ID NO: 2444 - DNA, 878 bp, Homo sapiens
  ref <308>: DATABASE ACCESSION NUMBER: Contig50094
  ref <309>: DATABASE ENTRY DATE: 2001-06-18
gggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgactgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactcc

SEQ ID NO: 2445 - DNA, 522 bp, Homo sapiens
  ref <308>: DATABASE ACCESSION NUMBER: Contig50106
  ref <309>: DATABASE ENTRY DATE: 2001-06-18
aatttcatagcaacatgtttatttaagccctagctaagttttcatttacaagcaaatattttcaggggaaaaaatcacataagacaatattttcaaatgttataccatctacataaaaattaaacttgcagaatttacaaattaatattctgagcagacagaaatattatacatccttttgcaaaatccagtcaacaacttttaaaaattcatacaggcacaacacaagatagtctctctatacaatctacctatttacatagcttttcccaccacagatgataatagctctcatcatagctaccaaggttcgcaaacatagtatatttaaaatatatttagcagcatataaaaaattagataaaagggaaggaaatactactattaaataaaaacaaaattaaatggtcataatagaaacaactccataggaaaatagatcaaaatatatttctgttaggacatcaacaatgtttcccatcacagaatatatgcacagcactggaaaaaaaaaaaaaaatt

SEQ ID NO: 2446 - DNA, 518 bp, Homo sapiens
  ref <308>: DATABASE ACCESSION NUMBER: Contig50120
  ref <309>: DATABASE ENTRY DATE: 2001-06-18
agtaacagaaaaaaatatatatatttcaaaggtaactagttttgttttactcaaactatttacaacaaggggcagagtagagacatgaatagctgcacaagttattttaattataaattaataaaagcctacattaaattcatcttattaactacttatgagagtgtataaaaactgatgaagccaacattatttggtacttctgatacttccattcgcttcaacttttctttctaaatagaaaattaaaagatggcaagccatttacaaaaagacatgtaattttgttaatcaggttgacattttgaacatcttcctcttcagttcagctgtcttctcatctatcttagcataggagtcctctgctgccttttcaataccgtcgtggtatttctccaaagcagttttcaagtttagaaatatttcctgggacttcagtttctccctttcagcagcatcttttagttgttgaattccaagtttaattttttggatttcttgattaattgtggttactc

SEQ ID NO: 2447 - DNA, 421 bp, Homo sapiens
  ref <308>: DATABASE ACCESSION NUMBER: Contig50153
  ref <309>: DATABASE ENTRY DATE: 2001-06-18
ggcggaaggcagtcatagcaccatttattgtccaaagtacacacacctgagggcccctccccacacagggaaacaggagaaacaaatgacaacaaaacagattctttggaaccgagaggggaaggggaacggggaggggagtttcttccttccctcagctttcgcctggaagcctagaactggcttccagccctagcccctcagtgggcagactggggtcagcggcttcacagagaagtagaggtgggcaggagaggcccaaagcccagctccggaggcccccgaggccctcttcttcccccaggctgaggggcagggagaactgtgcccaccatgcccggactcccggcggcattctagacaggccaccgcccactctgggcaccaacctccttaagggagggagaccagcctggatggc

SEQ ID NO: 2448 - DNA, 471 bp, Homo sapiens
  ref <308>: DATABASE ACCESSION NUMBER: Contig50189
  ref <309>: DATABASE ENTRY DATE: 2001-06-18
atatgattattccagaatattttattttcccaaagaaggttaaggatagaattttgtagagtttttgtttttttaatgcatccaacacataggagaattttattttaaagccctttttaaaaatgaaaattctagttggtcatcaattctcttcagagcaaacatcatttattctactctataaaaagaaacctaaacaaattaagatgacaagtaagaaaaacttattctctttatctcctttaaaaccaaaattttagttctgctgggctggttttcttcaaattctcattattttaccaatgaggcactttataatacaaatgcttaaagtgttgagggattctgactcccaaaaacatcatttgatataacaagatttgtactactgatgttgatatacacaattaaatctttcttctagtgaatgatgaaaataaatgttgaagtaaatactgatcaaataaatgc

SEQ ID NO: 2449 - DNA, 863 bp, Homo sapiens
  ref <308>: DATABASE ACCESSION NUMBER: Contig50276
  ref <309>: DATABASE ENTRY DATE: 2001-06-18
gatagtttagcattttatcctcatttttaacctacaaagtgtaatgttctcataaagtattttaataaatatattaaggcttaaggtaattactggtttgagtggcgggtggtttgctttctagcacactagtttacattcggaatcttaaaaatgaaaacatttgccatcttacagtgagtgatacatcacattggcttgccccagtttttgtgttcttttttttttttttcactattcaacatgtcttcgtattatcttccttcctctcgtatctgatagacaaagaatgatataaaattttggttgaaaaaagccagttgattgggatgactagaaatgttaactttttcagtaaaaagctttcaccgaatcactgggcagttagtaatgcagcttacaaataaataaagctgaggcgagaggtttaaacagcaagaaaagctgcagagcatattgaggaagggaagcagtgaaatggtggttttaatacatcccaaactggaagcaagaaccctaacacaaagaggattggaatactctaccatctgtaaggaagtagctagctacaagccacctcacacaaaacacccactaaggcctttcaccgagatcctcttgttatattctcattatgaatccccagcaggtgcacctcaataaataggtgtggaggatactgctgaggacctctaggtcacctaagcagaaactgctgccatcaaagcagactgccaccatgcatccgcggagaactccctgcctacaaatgaaactggtagcgctcatcccctgtgcccgaggaccgtccacaacggaggtgctttcttgcaagagaagcagcaaatgatgacagcgtgtcc

SEQ ID NO: 2450 - DNA, 527 bp, Homo sapiens
  ref <308>: DATABASE ACCESSION NUMBER: Contig50288
  ref <309>: DATABASE ENTRY DATE: 2001-06-18
gggtttgcacagtttattaagataatcaatcaatttcttaagttattcctttgttaaccagacagcatctctggagagaaaatgcactctctgtgtagatacataaaaatacatcagtcattttgcccctcctggatgtgaacggaatctcccctcctcacctccacagagggagctcaagccccagggaaccttcccctccccttttatgcattaccaggggagtggcaggggcagcccccaactgtggggtgcattcaggtctgaggggggaggaaggctcagaggggcatctccccagcaccctgccacagtgctggcttctggggtgtttgttcagcggcctgctgggctgccccaggctgggggctcccccagctccccgtgcatcctggcttgttccacggagccctgagccaagtctttgtctggctcatgttcctctcacaacatcccacaggcaggggtgagcctgccgcaggaaggagtaaggtgctgtcattgcggaatcgattgcgcacaggaat

SEQ ID NO: 2451 - DNA, 510 bp, Homo sapiens
  ref <308>: DATABASE ACCESSION NUMBER: Contig50297
  ref <309>: DATABASE ENTRY DATE: 2001-06-18
acttttcaaagattttactaaatcatttttttaaacaaaatatacattaaatctcagatttacagaatatagaaataatttatccaaagaaatttgcatttaaaattgttaatattgcacccaacagtatgtctttgacacatttgcattgtcaatctttcccacaatttgcaaaaacaggagagaaatctgaaactaacagaattacacaagctaagttttctgtaaaaaaagaaaaaacttacaattttttatttacaagttaaggaaaagttgtaaacgttcaggattttacttccacagaataaaaagccatacattcttttatcatacctagaaaatgaacatatacacattgtgattacctcataggaattcaacaggactgatattgtgaacattcacagcccaatggtaaaaaacagaattctcgaactatggaaactagtgtgtgaaagacacagaatgagaaaaatgtctggaaaaaaattactttctcctctttgagga

SEQ ID NO: 2452 - DNA, 549 bp, Homo sapiens
  ref <308>: DATABASE ACCESSION NUMBER: Contig50391
  ref <309>: DATABASE ENTRY DATE: 2001-06-18
ccctttacagttttattaataattattatttttcgtataccggttgcactgattcatttttgctcttttattttttaggcagatggctggtttttgtaggattaagcagtgaggaaaaacagcaaactaaaaatgctacttcaaatatagcaacagtcactacataaggcttaaatcaatatattgcaagtaatttctatgaattttgaacaatacaatgtagtgtatgtggaaagatcttgcctaataagtttcattctactcctcaaagttactgaagtcagtcaactattaataacagaattgtttttatagaaagattccatcttctttactgttagatgttatacgtgtcttgtactaggataaaataatgagcattgtgcatcgcaccttctgataatctcatacttctataaatactaagataaataatcactcttttaaatttagagagagttggttttaggctaacaattttttttcttctttccaagacagagtcttattctgacgcctatgctggagtgcagcagtgcaatctcagct

SEQ ID NO: 2453 - DNA, 513 bp, Homo sapiens
  ref <308>: DATABASE ACCESSION NUMBER: Contig50410
  ref <309>: DATABASE ENTRY DATE: 2001-06-18
cccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtg

SEQ ID NO: 2454 - DNA, 795 bp, Homo sapiens
  ref <308>: DATABASE ACCESSION NUMBER: Contig50523
  ref <309>: DATABASE ENTRY DATE: 2001-06-18
aaaaaaactacttttatttttttttatttctttttcagttacatacttttaaacagggatgtgtttcattattcagacattcaggcaatgttgacttcattagtgttgacagaaaataagcataaaaatgcaaaacattgttggcttaacctgaacatacctgcattacctattattgaccagtttgtgttgccaaaagacttattcctcggcattaaaatggagcacttaaaaatattgctaaaaagcaaatgcctacacactggtctttgcagcaaataagggtatttatacttttaaaatattttaagtccataattggattaatatacacaccttcttatgtataaggagttcagatcatataaacactgtacaatccaaaaaaccctactgagaataaaactaaataggcttatgataagaaatacagatattcgcatgtatttacaaatatcatagacacacaagtttggtcaaatactgtaaagaaagaagaagtggtttcacattataatggccaaaatgtttatctaccttgctcaaagcaaataaaaatataaactcagtatgtaactcctgcagtttaagacatcatgacagtatacagatagatagaaactgttgaccaaattatacagcaaatgttttgtaggttaagtgtaggtctttaaaataaaaaaaagatcattcataggattcatagcaacaatgataaacaatgtcctgatttgtggtgttcatgtgggtgcctaattcatcaaaaaaaaatgcattaaacttttggctaataag

SEQ ID NO: 2455 - DNA, 1303 bp, Homo sapiens
  ref <308>: DATABASE ACCESSION NUMBER: Contig50529
  ref <309>: DATABASE ENTRY DATE: 2001-06-18
ctctgctggagcaggacttcagagtgtttgttttcagcctgcttttaaagtgatttgaagagagcggctttgaagattatcgcggaacacctgcccattaatcttgaccctgttaaaacaataactgcctatccagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgt

SEQ ID NO: 2456 - DNA, 502 bp, Homo sapiens
  ref <308>: DATABASE ACCESSION NUMBER: Contig50588
  ref <309>: DATABASE ENTRY DATE: 2001-06-18
cagtgttcagtaactttaatacagaaaatctatttgatatttattaaacttagtttctccaactatggtttggcattgtacaaagcatcttaatgacacagtagagttaaaaagatctttacaaattgaaatgtgatacccttgtctccaaatattttaattgccataaatttgtttaaaaatacacattaaacgcatgtttgacactctaaactttctatactctcaataccacaaaatacatataatatactatacagatgtggaaaaatctagttagtatataatactttgctcaccattaacagctttatcgtgtgaaatgcacatactgacttagaaatcctagcttttgagccccaaagtacctctgaaattgtaatgtattgcaacaaataaaaatcacagtatataattgaaattctggttgaaaatgtcagatgcctaaatattttggataaaagaaatgtaaaacaaagatttggttcatgtacaaaacaaa

SEQ ID NO: 2457 - DNA, 513 bp, Homo sapiens
  ref <308>: DATABASE ACCESSION NUMBER: Contig50592
  ref <309>: DATABASE ENTRY DATE: 2001-06-18
catttctttccttattctcctcttccaatgaaagagaaccataaaggttgatttcttcttcattttccttaaaaaatttccttgagtctgtcatacaccagctccaataacaccaaaggacacggggagagcccactggtaccatcttggtaaacatttaattagaccgtaacccttctcttggggcagaggtcatcttgcacagatgcacatggttgcctggagtctatcgtacaatcatgtgcactgctgacagtctaaatgacaccagtgtcccagttttgtgctgacagtccacagcaggcaatgtttctgcgactgcaaacctgaaggcgacgaggagtttctactttcttgatcagcatgaaggggcagagatcaccagttggtggcaacatgtggaaggccatgaacccctaaatctaaaaatgtcactaagagtcaaaagttccagagctctctcagtgatggcacacccaactccaacccatgtctttgaggaagctgagaaat

SEQ ID NO: 2458 - DNA, 687 bp, Homo sapiens
  ref <308>: DATABASE ACCESSION NUMBER: Contig50669
  ref <309>: DATABASE ENTRY DATE: 2001-06-18
tttgatagtaagtgagcttttattttattcaccataaaatatttgcatctcttactcctcaggttcttacataagacaacatttaattaattaagttaccattatagccatcgagggcctgagaaaccacatcctttgcaactgtctcataaaccaagtcctgggaggcatcgtgaagaactccatccaacttaaacgaccagtctgtctgttggttattgacaactcctctccgaatgtctttttttaagtgaatatcaatgcttcttttgtcatctccgtatctgatcatttcatgagcaaagtcatcggtgggtttgacacggacaaatgcatgaacttttttcctagtacccattctagcgttcaccaggcagcgacgctcccgggacgcgactgccgcaaccgaaaccacctgcactccccacgcggggctgcctggctgtgtacatagtcgccatggcaacgggtcgcttccggggattccggaagtgtcggggtggcggaaatgaagtccgaggtcctacgtcgaggatacgggtgaggtcatggccgaatcgggaagacgagagatggggccgattgatctagaaagacttcggcggatgcacatgcgaagtcaaggtcgagatagcgagggaacgaaggccgcacatgaaccaggaagcggagtggcggggcttccgg

SEQ ID NO: 2459 - DNA, 490 bp, Homo sapiens
  ref <308>: DATABASE ACCESSION NUMBER: Contig50673
  ref <309>: DATABASE ENTRY DATE: 2001-06-18
gggtttggatcattggattttattaaataaaaaagagaagcaagtacaaacaccagtcaacttcagaaggattttaaaattgcaagtgtgccatgcagctaaggtttatcaggctcctcagttagtctgcactgtccttggggaggggacacagctctgaggacaggggatatttcccagggggttctgggatgaggtcagcactaactgggacagcccctgtacaacaaaggagcaaacctaggccccagggggatcctgtctcaggagaaagagagaggcaagaagggaagaggacactatcatccacttccaaggaaagccacctcacagctcagtgtgtgcaaacagcagctccgctaatttccagtaaggaggccaaagtcaaaggcacccatggagaatgggataattcaacaggaaagactcggtcattagggaaaggagcatgctaggacaggtctgggtgcacccctgaatctagctctga

SEQ ID NO: 2460 - DNA, 491 bp, Homo sapiens
  ref <308>: DATABASE ACCESSION NUMBER: Contig50719
  ref <309>: DATABASE ENTRY DATE: 2001-06-18
gacagaatgagaaaattatgctttttattatagtcacataaaataaagtcagttacatcaagttgtccaaatgcattggtgaattaatgccgctaacgcttacaaatttttatacatatatctatgcatttataaatacatacatatgtaaaagatatatattttctactaaaataaagtacccaaatcttgatatatataggggcataatgggggagaaaagaatcataaggttttatcagttgtagactgtactttcagaatacaagagtctgttttagacacatttattcagctgtaatgaactttaatcacccattcttttctgaattctcctaagtgagttaatgtatccaaaatatcaaaataagtcatgtggcaaacttaatgaatcagaggctaatttttcttactgtacctggctcaaagtctagacttcccaatggaggcatggttaagctccattcttaatttgcttgtcttttggactg

SEQ ID NO: 2461 - DNA, 562 bp, Homo sapiens
  ref <308>: DATABASE ACCESSION NUMBER: Contig50728
  ref <309>: DATABASE ENTRY DATE: 2001-06-18
aatttaaagaaaacttctttattaagtaaatggacagttggtacacagatattgcaaaaatttcgaggcgggtacatgaatgactgaaattcaggagacgcggggagttagcacagaagcactttcctcattcagagctcttttggctgcgagaaacagacacccaatcaaatcagcttcagcaaaatgagagaatgtatcctgacaagggacgctcacagggcctaaaggaagagtgctgggcccctggaggactgagggaagccggcaggtccctggaggcggtgcccggctgctctccaggcgcctgtgattcctctggtccctgccttgctatgcgtatcttccctctgagcagagccattttctctaccacattcatgcaggtgcccatcccccgcaacacacacagacaaacacacacacatggacacagtcacagctccagggtttctatgtgttcaggtaagggacctgcaaagcctgaacagcctccctaaatctagatgcccacctctcatcctttcagctcccatcagaggatcaaggggcccaaattcgc

SEQ ID NO: 2462 - DNA, 736 bp, Homo sapiens
  ref <308>: DATABASE ACCESSION NUMBER: Contig50731
  ref <309>: DATABASE ENTRY DATE: 2001-06-18
aaggttgaacgaagacatttatttgtaaaatcaattctcaatggaggagagattgtatccatagaaagtaaaccagtgatcgttcagagggccacatgcacgcattagtgaaaccaagggaaaaaccaaaaagacagcactgctgcggacgacccgcgtggctactaatcctgccaacagaaaagcaaaatgtcctttccgcttgagaacgcggatgcaccaagatgtcctgtgagaaggcaatttggtctgacatccacgatgaagtgatcagggaacaagtgggggagcgtttttttctattccgtgtggcctgcttgtttcccgcagaaactggctgaccgcttccgttgtcctcccgcctccagtgggagggaggtggtgtcaaatccctggctttctcacatgcccatccttatgctctgaatgatctgaaagatagcttaagggagctgatggctgatgagatgtcttcaggctgtgcatctcagatcccgaggatgaactccagagcagatgaatggcctcagtctttccttcagggccagccagttcctttaaacatctcagttgccggtcttgggggtggggtgactccctctggatgttacaactttgagaaagttctggcagtctccaggagaggccaatttatgtggttgacctgagccacagacaacaaagacaaacagtgccaacagccatggtcccacaggatatttctcctcttgcggcc

SEQ ID NO: 2463 - DNA, 665 bp, Homo sapiens
  ref <308>: DATABASE ACCESSION NUMBER: Contig50802
  ref <309>: DATABASE ENTRY DATE: 2001-06-18
tgaattcagtcaagtttattaaacttgctgtgtgctcagcaccgccctaggcagtaacatgaaaaacattacaaaagaagatctcaacaagggaaaaatatattctgtactatattaatttccaatcatttacatgttgctttttaaagtgttcttaggtcactttggggtatgtggtctccttctttctccatgttcccctaaagcttccacactgttgaattatgtgcctgtggcgaccatcctccaggaagggcaccttcctgctgatgaggcaaccatgggttggtcagggctggggtcccgtggtggaggagacatgctgagagaaaaaccatcaaccccgagagctcaggacactcacagtgaatcccagaaggccaaacgtggggaagccacaaagagggctctgggcccctcactcaccccctcccctaggggatgtgcttaaagtgctaacgccgtaggaaaatgatgcatagctacaagccgtcctgggtgctactagactcatcgcctgcctcttcctccctaacttgtgctaatactgggcgatggcacaggccaatagaaaagtctagtgcccagtgaagtagtagagaaggtccaacgtgtaacctagaattcccaagaggaggtggggacagaagagaagaagtgaaggg

SEQ ID NO: 2464 - DNA, 626 bp, Homo sapiens
  ref <308>: DATABASE ACCESSION NUMBER: Contig50822
  ref <309>: DATABASE ENTRY DATE: 2001-06-18
atccaatttgatttttaatgtaattaatagtgatttaattttcaaaggagcaaataattacaaacaagagaaaacattgctgagatggtgcctggttgcttctattcaggccattgctgaactatatagaaaaaaagtatattcatggtgtcttcattattatgaaaatcacagtaatatgactcatcaggaaatcacaataattttatgacagaaacaatatatttagaacgaatctgtcagtatttgactctcttttgagggaaaaataaatgaaaaccacgttctctggaaagaaataagacaagaaatgcccacagttgcattctgctgttgggaatacatctccaaaattcaaggttcaaaggttatcacatttaattttcaacacttatcaccttcttcttctctcaatttatggagatagatttctacgttcattattcgggattattagaaatttccttcagtttgaacaatgcgtaacaagtattctgtgacatgggtgcaaaaagttgtcattttcaatcaagttataagacataactgtgcataaagtgcatttcaaattaaagtacccatcaggagagaaatttaaagtgcaatacataaggtactttacatag

SEQ ID NO: 2465 - DNA, 964 bp, Homo sapiens
  ref <308>: DATABASE ACCESSION NUMBER: Contig50838
  ref <309>: DATABASE ENTRY DATE: 2001-06-18
agggtatcaagattttacattactaattctgaattcgttatcctttgctttcagccatattaaaactgaaagccttccatacctgacgtttttctatctcattatacagctttcctgtcagatcttcttttagggtgactttgaagaatcagaacatcagggctccaactctcagtagagccagtaaccagcttcctgatttaaaaaaaaatcacctttggcctaattttgtcacttataaacagtggtattgcagtaccctggtatgattagttatgatatgtttaacaataattttaaaataccaaagcttgtgaattattttactttcaaaaaatatgtaagttagaattgtaattctaaaggcactgtcgtttgcttacacattctaacatatttctaataagaaagtacctgctttcttaagagaaaaagggataagttaccaaaagcagcacgttctcctgggctcataccccggattcatccatgaggccacttccattgtaaagcttttagcatctcttgatttctcttgacactgaggcacaaaggcctgctacttataggcattacttcatttttccttacgcacggccccccccccccccccccccccccacagtatgtttaaaaatcccaactgcaagatacacaggatgctgtaggcctgatttcctgttgtagaacctccagccctgtgttgaatgaggaggtgcaaatatatagacccttaagatcagaccacagcaggcattcaggtggaggggatgaactccattcattccagctgtgcagtgggacatctgcgccctccgcatctcggctcattcctcatctgagccactcaagagggcggtctggtaagtgtcatctgaattcagcttctgaattccaatgatttctccccttccgtgtctcttcatccgagtcaaaaggcagtaaacaagagaatagttgacgg

SEQ ID NO: 2466 - DNA, 630 bp, Homo sapiens
  ref <308>: DATABASE ACCESSION NUMBER: Contig50850
  ref <309>: DATABASE ENTRY DATE: 2001-06-18
caattgcaaaacaggtttacttttttatcaaacaagattatcacataaaaaatagctacagtgctacggtagtatataaagtgctcaagtatcctgaatgtaaccatgagtcatgacaagtccctccctgaacgagagagagagggcgggacttctgcctggctgcttgaagaaaaatcttcgcttgggctgatgaacgtggcctgagcgggggctgacgaggcacccgggttgtcgtcctcagacaggggcgtgttcttgggtgctcccccagattctctgcaggcactgtcttgattgaaataccaccggctggggggcgccatgccctgggtctcttcccagacttcctggtttgccaaggctgcctctttgcttgcctctgcggagagttccagcacctgggcaaagctccttcggagctcaaggtcctttttcgccgtcacgtccttgagttcgctcagtaagtccagcacctgcacattttcttccgaatcaccaacatcaagttctcccaggaggcgctgagtggtcaccagttcatgctgcagggcgtctaagagctgctgcccatctccctccaggtggatggacctcacgggcagctcgtgcctggtagtgtccagggcc

SEQ ID NO: 2467 - DNA, 708 bp, Homo sapiens
  ref <308>: DATABASE ACCESSION NUMBER: Contig50860
  ref <309>: DATABASE ENTRY DATE: 2001-06-18
aaaatctcttctgtcacacacagatgaactttaataaattacaaatgcacctgaaaatgccttcttgatttcctttcagtttaggcctcaaatgggctctcctcaaggctggacctcaaaggcccagtttgggccttcgcaaatgtctctaacccttgacttagagtttgaagattcattccattctggatgtgaatgcaggtaacacccagtttgctgacgtctacaatattccgcctctcatcatcaaagaagatcatctgggagaaaggaattccagtcttctgctgcaacctctcaaagtgtgtgatcttgctgcctggatagatttcccgatgaacaaagtacctgaagaggtcaaagagctccagtagctggttggccccttctatctcacttgtccttgaagcagccgcaccgggcaccccaaggctctgcaatcgttttaggacctcaggcacctctgggtacagtcggacgtcttggccccgcctatctcgtacagttccatcactgctcttatggaacggagggtctacgtgcgtgtcgacccagaaaggccagagagtgtaatccaaatcaaagactgccagcttcggtagccgcgccatgacccgcaccgcagcgtgcgcgcagcagaggtggggcttcacccggggccttagagagtgcggaacctccggcagctaagcagccaccctgcctgcc

SEQ ID NO: 2468 - DNA, 658 bp, Homo sapiens
  ref <308>: DATABASE ACCESSION NUMBER: Contig50913
  ref <309>: DATABASE ENTRY DATE: 2001-06-18
aagatttacccattttttattttttataaaacaagctacaaatagtttccctctctccttcacaaaggaaaaccacacaacaccacctacacacacgatcctgtgggagacaagatgcctggggagatctcgaagatccaaacatctacaggcaggcgccgtctccatgtgtgcatgcttcctccaggcctgaaagtggggccagtgtctcgtgcaaggcccactcagctccggcacgttgagttctctcattggggctaatgggagaaggcttccttcccacctttccacgttggggcagggccaccagtcattcctgagataacctctaggactttctccaggacagcagggacctcctttagcccaagaccccatcagatcctgtcccgagaaggttgtgctcctcccacagggacagtgcttgtggtgccaacgccttccagacccggaacgggtggaggtacttttagggatgtcgggttggaatacaagatgaggccagatttgcaagggtgatctgaggaggggaccagtccagggctacccaacctccctcactgccaccacagctgcttatgggaaggggcgctaagggccacttgctgctctgcctgaaggccacttgaataggcacagcacctgggcagagggagct

SEQ ID NO: 2469 - DNA, 475 bp, Homo sapiens
  ref <308>: DATABASE ACCESSION NUMBER: Contig50950
  ref <309>: DATABASE ENTRY DATE: 2001-06-18
agaccttcatcttctttattttatatatgatgcttcttttaatgcagccaaaagtgatatttgcttttctcagaaccataatcgatacaagatgcagtgaccaattcattccttaaaacacctgggctccttaaggggctagaagacacaagttacatccagcccatcagggagccagaggcgggaggggtccccagccaagctctggcaggcctgccatggggcagggcctgaccgtgcagccagaggctggcagaggcctggggaagggtgggcagaggcagctgggctctcagtcctggaaccggagaccaagggctgctcatcaagctccgtcaggcaagggcggcctcatctgtgcctggtagattctaactgcttccaaggtagaggaggacgcgtgcaggaaatcgtgtcaattgtcaccttctgcctgcctcccacagggacactctgggttgggagcctcttccag

SEQ ID NO: 2470 - DNA, 680 bp, Homo sapiens
  ref <308>: DATABASE ACCESSION NUMBER: Contig51066
  ref <309>: DATABASE ENTRY DATE: 2001-06-18
aagtaatagtacttttaataaaattaagttcttaatagcacatttaatacattaaccctcccccttcttggtttctctgcattttgtgcaacatcactttgacttgattattcttgggtctgttttatttcccgcttttattttgcttttgaaatctttttccttggtggatttgtacgtgtcttcactagatgcctcaaattaagtctgaccacaatcctactctactttctacagtggagagaccatcctccctgccccagggctgtctccacccacccccccttccccacccgcaccctcgagtggggaaggggaagccctccccaccccagacgctaccatcccaaactagcggggtttctaggacaaaaagagcagggggaatctgtccctaggtggggcgagaagagtaaattgggtagagggagatgtgtttggggtctagggccagggagggggatggcagagtcattggtgtaatgaagcaggctcctcctgccaaaaggagagccaaggggcccctccaaccccttggataggaggggaaggcccagtgattgcaagctggggttggtagaaggcaagtgctttaaaaatgttgatttctcacacgcagaagccaagccctccagttttgtgtggggagggcaatgtgttcccaggccagggtacagtag

SEQ ID NO: 2471 - DNA, 691 bp, Homo sapiens
  ref <308>: DATABASE ACCESSION NUMBER: Contig51068
  ref <309>: DATABASE ENTRY DATE: 2001-06-18
ccgtacatagtaatattttattttcttcccaatgtggtaactaaaatacatttaaacgaaggctagaatttaaaacaaaattcttttactgataagcacacttgcaaagtaatgaaaatgttacatgcattgctttgcatataaacgtccaagaagtatttgttgaccaaatgtctgaaaatgaagtatttttatctgttccgaaacgccataatattgcaaagaagcatttcaaattattgttgtgtgaaatgttcaaatttagcattcaaatttagcgttttcccacattttacccttcaatttacacaatttggaagaagagtagatgagttggtcattgttacttaaaacaatgcgtcaccttgttagggaaagaaattaacataatggtcaaggagtgataattaaacagaacatgacatttgctgtccattcaatgttaaagttctaagcaaattagcatggagaaaagggatgggtagaaataataacagagcactagttgattagtccgcctccacatccacgctgcaggcgttggacagatccggctttactgagtccaccatgcagggaaatggacgcgcgggctaagcggaatcccaggggcgcgatcgcaccggctggcgttccagcaaaccctgcatcccaggccctggattcaggctgccttctgagtctttgactt

SEQ ID NO: 2472 - DNA, 545 bp, Homo sapiens
  ref <308>: DATABASE ACCESSION NUMBER: Contig51105
  ref <309>: DATABASE ENTRY DATE: 2001-06-18
taggtaaaagatttttattcttatttaaccatgctgcatgtatacatacaataccaatatatacaacttgaacaaatacaatttatacataaaatacaatgaaagcatggcttttgaaactgatgcaacaaactgtaatttgtaattttggccagcatacagtattatagtaatgctactgaagttattcattaaattagtcagactacagtataagttcaaaggcactagaaacatctatgttttcttctagtatttttaagaacaaaaaataatttaaaataaaacaaatgtatacattaggaaattgggcagacattggtgtacttaaatgtaaacgctacccattccttaattcacagccctgtaggaaagaagactttccttaagagttaaggggaaggatattaaaaacagactaaaaggaaacaaacaaaacaaaaaacaaccaaaaaccataatcatagttttaaaaacatgttacagaggaagtagcaccaccccctcccccaataaaaccttaaatttttgctgtaaaaaaaaaa

SEQ ID NO: 2473 - DNA, 539 bp, Homo sapiens
  ref <308>: DATABASE ACCESSION NUMBER: Contig51117
  ref <309>: DATABASE ENTRY DATE: 2001-06-18
ggctgtaaaatcatatatttactatgtttgaaagaaataatacaaaaaagagaggaaaataaaagcaaaccctaaaaggtcactaaagaagtcataccaacctcatcacttgctttgtatcatctattcatgcaacagcagtactattactccacctggacacagttaaactcatcttccttttcaaaaagggatccaattatttcaaaaacctttgaagcagaggatttgctttattaaagattatcttctgttaggcaacactggcaccccttgtttgcagaagatgattacgtggtggtttaaacactggttgtaaaggaatgtgcctcaaaaaaacaggaaggaaatcaataccagatctattcatttaaaaagctaatggatggaacccattactattgattttcaattagtatgatgccctatagttttgttttcagtagtaaaggtatacagtttacgatttaaccttaaaaagaaataaaagacttatgctcaagtcatttggccaaaagatcaacaggctgctctttgag

SEQ ID NO: 2474 - DNA, 721 bp, Homo sapiens
  ref <308>: DATABASE ACCESSION NUMBER: Contig51196
  ref <309>: DATABASE ENTRY DATE: 2001-06-18
gcaaagcaaaactatattttattaataaagtcaatggtaacatttgcttacgtattagaaatagccctgtgaaattttagctgcaaaagggaatcgtttaaaaagcactgctcaactccaagtttgacttacagacaaggtaacagccaccaaacaaatgaaatccctcttctcctttacagctgctccttggacagagggaggcccgtcatctgggtctgaaggaggctcccaagactctgacacagaacactaaactccagggtgttctaggacagtgacaggcaaggctgttctcaatcatctcctgtctgacacggacatcgagctaagctatgagcaagggcgaacaatgcctctcagcagctcctcctccttgaccaggctcccgaccacggagcatttcagtcaaggtctagggatttgagggtggaaggagagaatttcatcactggggaggaactcccctcacagaccccccagggccactcagcttcaatcagctgtaacccagccccaacatctgcaggccactgcgcagggagtccacggtcagcagccacctcagcacacctcctcctgtggccacatcttcactggtttctggaatccaacctggggccttcctgaagccaagtgagaaactcaggacaaggcttctcttctttgaaagccacatcaagtagcacaaaggactgaggtttgcagctattttatttac

SEQ ID NO: 2475 - DNA, 456 bp, Homo sapiens
  ref <308>: DATABASE ACCESSION NUMBER: Contig51235
  ref <309>: DATABASE ENTRY DATE: 2001-06-18
gggatttcattatctcagtttactttaatttgcttgtttacacacacgatctgtgtgtacataacagtggcaagagccattctctaaatacaatctggtacccagactatgacagatgcacgtggaaaatgaggcgtcagtgaattaatctcaacatagaaaggcaaaataagcatggcagtattctatgatcacagatgcccccagagcctgggggtaaccgacacttttcaacataatacaggacaattttaacaaaagacccagactccaaatggcacccaaaatatattcgtttctctgccttctctagaggagtcagaaagttctaaaggcttactcaagaaaaaggaggcagggagactatggcctgctaagcacagatgctgagcactttacatgcaccatttctcttcatctccacctgacagacgatgaaaacgaggtttgccatga

SEQ ID NO: 2476 - DNA, 437 bp, Homo sapiens
  ref <308>: DATABASE ACCESSION NUMBER: Contig51254
  ref <309>: DATABASE ENTRY DATE: 2001-06-18
atagtgggtccattttccaataattctcaaaggagtctgagattccccaagctttcagaaccgctgatttgttctgtgtcagaccttcccattcattgtcttgtcatctcccacagcctccagaatgggaaaatacacatcattgcatgaaagaatcagtattaacaaaacattaatgacattcccttccccatccctgtggatcaaggcaagaagggccattcgccgatgcagataccaggagttggaaggccgcagcagttttgaggcctgcgttcagtgtctggacttccaggtcaagttctgagggtctatggcatctggctgaaatccttgcttcagggaagcctcatgtcctggctcacatgtggaagggggcatcaggagccccctgggccctgtgaaggcccatagattcctgtgtggaggccaagaga

SEQ ID NO: 2477 - DNA, 665 bp, Homo sapiens
  ref <308>: DATABASE ACCESSION NUMBER: Contig51352
  ref <309>: DATABASE ENTRY DATE: 2001-06-18
tattgggatctcattgggagaaagtctaggcagattcctgctctgctgggccttctcttacgccagtgtggacttcacgggatagggcagacagagtattcgttgcatttatttgttctatcactacagaagaagcatttcaaaatgtgtacaaaaggatactctattcctccagtggtacatcccttgttcacagctaaacagcaataatttaacatcatcatagaggcagactggaaatatgactgcatttctcatttacaatcctgtgcatgtactcgccagaagggcagctgaagacctaaagctgtactggatacaacagattcgacctgaacaatcaccacacacaacattataaaaaactgtattagaaagtattggaaacaatattgcatattaatatgtggttacacatgttcacagtgagtgccatcgcaccaaaagcattatgtgcttcttttttctgatgcctgtacatcttaaataagtctaataattttggttcatcttaaagtaaaaatacattgaaatgaatgagagagatctagattttaaaaaagttgaccattcattattgctggaactgaagaaaggaaggatacactggcatcacgatttgtctacataagtccagttcatctcgcgtttgttttggcaagaag

SEQ ID NO: 2478 - DNA, 1236 bp, Homo sapiens
  ref <308>: DATABASE ACCESSION NUMBER: Contig51369
  ref <309>: DATABASE ENTRY DATE: 2001-06-18
acaacataaatcatttaatgtaacatttgcaaccttagaaaggcagacatgtttaatccaagtccgtttataaattccaatttcacatggattaaaaactgcagataaattaagtcacaataatatcctgtacatgcattaaggctggtgactgctaaagtctcttgggaatctacaaataggaaatcacacgcagattactgggtctgaagagtgtctacattgttaaaaaaatcttgcttttttttttttttggtgatgcagatttcaacagtaactctggaaaactgtgaaaaatgttatttaaaaatatatatgtatatgctactgcacagtttcaaagatgtgattcataaataatgttggctgcactgattaattttataacaattactgcacttccaagttgatgcgaacacgcagtgactcatactcaatattaggcactagtaatatccttcaggcgtactacagttttatgttagctgtattgtacatatatatttttaaatgtatgcatttatacaaactgtgtatattatgtatggggtgtcagaaatgtacacatcactgttatataatacacacatcattgttgtacatatgaggataagttttagtgcagaaagtctcattgcattgcattccatgtgttcaatctagtacacaatttgtcaactcttcagattatttttccagtacattcctcattagattgtgggtttcaagtttccatttgcaatttgaatgtttccagaaatctctgtcttaaccaaacctctctctccaggcacgattctgcacatgagtctgatctgtgtagagtagtatcatcaaaaatgccaaattttgatcaggaatatacctggactactctctttcaaaggcaattgaacatcgtgataaaggatagcatctattcaggtcatggaaggatatggtcagttgaacttgtgttgaactttggaggcaaatgtacgtcttcaaataaaaagacatggtaataaaaattatttgcttaaatttgagagtctctggaaggatatacatcaaactgtgagcagtggttgtctcaggcagaagggacaaccagggacttacactttctactttctacatttctgcactgtttgagtttttacaatgagtagatattacttttctaattagaaaacacaagaaaggtatttcaacttgaaacaaaactaaacaggccaggcatggtggctcatgcac

SEQ ID NO: 2479 - DNA, 1355 bp, Homo sapiens
  ref <308>: DATABASE ACCESSION NUMBER: Contig51392
  ref <309>: DATABASE ENTRY DATE: 2001-06-18
aaaagttctctcccagacatgagtatattttaaagtacatattaaaagccagcagtttttttttaacagcaaaagccataaaacaagcagttctcaatttacagttaacatagcagcccatcaagtgctcctctcccttagcatatatggtactttgatgcatattgttgatattgacagtcattttgcaaataaatgttctgaaagctttcatcttatttaaaggagtaaacatggaaataaaggcaccattttaatcaggttattgtgataagaccaaaaacattccacaaagtgcatacctcattttgacttctctattaaatttaaacttgagttaaaatgttaataatttggctttaattgaagagagagttcattcagagaattacagagttcgaattgggatgaatccccagagtttatttaatctggtaccctcattaattggaagaatgtgaggctcaaaaatgaaatgaccacaagagccatgactagaatctcttcgttactcagtccagtgctctatcataccagctactttcactcttctaacccacagtttaccgtattttctaatacatgctagtatattgcctagtacacaacatcctttcaaatattctttctttattctccaattcacttttcaggagaatagataacctcaatcatattgattctcagcctaatggtctcccttacataaattataatgacataagcattttgtatcactttattgttaccatcgacctcctacagtttgggggaacccaatcattctttaaaacattagaatgacaactccagttgatttggcatattgtataggtgagtgggaaagacttgtcaaatcccagaaaggggcgtggcaccagcaccacccaaccagaagaaaaatctctctttggtgctagtgtcatagctccctatctgttccgctaacccattaaatgatgtggtggaagaggatcctttcacaatctttgttcatttttttacagagcaaatggaagtcatacataaccttttacaaaattcattttttgttttaatttttttccaggtatgtgatatttgtgagacatcagaaaatcaatttatatttttttcctctgttaaaccaagccccacaaattgaaacctgacaggttagaataagttcttaaatatccacccagcctttgaattcttttgcttctagtgttggccaaaactgtctaaatagtacagcttcttctctaaggtagatggaagagattatcacaacagctcaacccactaaaagcatttgtattttataaataccagtcagcaaagacaaaaattaagatattcattttttcaatgat

SEQ ID NO: 2480 - DNA, 552 bp, Homo sapiens
  ref <308>: DATABASE ACCESSION NUMBER: Contig51403
  ref <309>: DATABASE ENTRY DATE: 2001-06-18
cacattttaacaacatggagattttgttattataaatttcaaaacaaaatgaaggaatttccacatatttataaccttcaaagtacaatattaatacatgtctgtcagttagaaagaacagcagtttgttaggctacaaggtttaacataaaaccaatttacaaatgtgaaaagcagtagtggtccaatattcaccattacacatgaatctgtttcttccagaattttttaaaattaaaattttagtatcgtgaaatattaaaataacaccccaaacatgccacaatcactattcacaaataaagttaaaatgaaatatacaaaaatccacttaatactgttaaataacaacaataaactacaagatttcctgaacagaaatggtaggacccctgaatgttttacagtgaatttcaggaaaagaaattaagttatgactattttcatgatatataaggcaaaaatttacacgaccatttcaaaatataccaattaagatttatagtttgtaagatgcactaaacaaatagtccttaaaagtgaacaaaaatg

SEQ ID NO: 2481 - DNA, 558 bp, Homo sapiens
  ref <308>: DATABASE ACCESSION NUMBER: Contig51464
  ref <309>: DATABASE ENTRY DATE: 2001-06-18
agagtttcacaaataacatttattgaccacattcataacagaaactcacccacattcacatgaactttgctacaaccaagaatcacctgatgagaaatcatttgggttgaatcctgggtgtggattctgttctgagaagacagcgactgtcacagacgcctcctgattggtggactctcaaagatcttgatcgtgacacatttttgtggctgttcttgacagtagctgaagattccaacttcaaaccccaaaacactggcgaatggccatgatgaccctcgggatggcctggaggagggtcaggaggccgaggggcagcagacgcgctgcaggagccggtagctggtcctggtagggggcctggagctgctggaacttggacaacaggcactcatcaccgcagatccgccagcagttgtgccagcagcatgcatccagcaggggtgctgctttcggggtctcagggacagagggacccagtaaggcagtgctgcttccaccctggacacaggcaggcggcccccgaatctggtctggcattcacagcagatggccagg

SEQ ID NO: 2482 - DNA, 451 bp, Homo sapiens
  ref <308>: DATABASE ACCESSION NUMBER: Contig51519
  ref <309>: DATABASE ENTRY DATE: 2001-06-18
cagctagaaataagttattttattttaaaacacatacagattaataaatattactggaaaacttaatagcctttttatttacatgaggcaataacaacatgctatgactacatctataaagcaaaatataagcaggtcttggccactgacacatgtgtctatgtatgctaattggaagctccccaatacatgtctatgacaaaacttttacacaaccaatcaacatttgacattttttacatcttcttcctctcatgattatattccattttcaagaaaataatagttatcctttgaaaaggcaaaacgctcaagccactgaaaaacagtatctaaatttctgtaaagtgcaaaaatactaaggtggggggcaattattatattctgacaaataaatattctgaacttttcaacatgaccctttggcactagtggtttgggagccctgaca

SEQ ID NO: 2483 - DNA, 447 bp, Homo sapiens
  ref <308>: DATABASE ACCESSION NUMBER: Contig51685
  ref <309>: DATABASE ENTRY DATE: 2001-06-18
atgttacaaatattttattgcaattttttccctttaacaatgtctggatattttggaattaatatctcggacttctttctaatccacattggttcatcttgttcattatgaacagaggattctactttacaatgtactaaaatgttgttatgtatttcaggaccattgaacattcaagttgtttatcattttctttgaccaccaacattgctgtaatgaatagggatttaagagcaaaagtaacgagaatacttgcttaaccacttatgaaaacatatcataaaagtagaacaatcaaaatggtggatgccatagagaaagcaaggtaacaaaataggaagcctagggaccaataaagtatatatacaaggatttcctatatcacaaaagtaacacttcaggtacatggaaaaagaatttcagtaccaaaaggcacctcagtctcac

SEQ ID NO: 2484 - DNA, 463 bp, Homo sapiens
  ref <308>: DATABASE ACCESSION NUMBER: Contig51726
  ref <309>: DATABASE ENTRY DATE: 2001-06-18
gagaacaccaactgtttattacaggaattcctatgaaacagctccaagaaaaaacccacacataggaggaaaaaaaataacaaagcaacactcaacagacatggggctggggcttcccccacagtgcgccgggtcctggcgcggggaaggctcagagacccgtcgagaactcgagctggggtaccgaggcactcctcggagacccccccccctccctccagggccccaggcctggcgcggggagcagcggagggggcgaccgctcctcggcagggccccccgagccagcgtcccggccccgcgcgcgtttccaaacttggtcacgctcggcggcggctgcgcgtcccggccctccccaagctcggcgttgcgagtccgggcagggtgggcgggacgaggtacgatcgccggctcgccttcgctacgcccttgtgatcttggggccacggaggccaccagggcc

SEQ ID NO: 2485 - DNA, 573 bp, Homo sapiens
  ref <308>: DATABASE ACCESSION NUMBER: Contig51742
  ref <309>: DATABASE ENTRY DATE: 2001-06-18
aaaaatgttagagaagaacatttattgacatgaaaaggtgtttcagatatactgatatgtcaaacaaatagtaaaacaacatagagtaatgattcattttggtaaaaaatatatatgtatatatagaaaaaaaaattctgcaaggacatatgctaaattggtaacagtgcttacccctgggaagggggtatacagatgttgatttactctttgggtacctgtatttcccagtttttctataaatcacatcatttgcttctgtcataagaaaaaataatatctattatcatcctttattttgatcaaaacaaatcaattttttaaaaaatcttaggtttttttaagaagcagaaataatttccaaattgcctccagagacaatgattttatcctctgcagaagctggtcagaaccttcttgatcacagccccagttagatacagggaagaatggcgcttcctacagcttcagcggcctcagctcagctctgtgccccaaggccaaaccagctcatctccagccccatccatcctattcttgctgagtcaccagtctcatcatcttcagagccat

SEQ ID NO: 2486 - DNA, 735 bp, Homo sapiens
  ref <308>: DATABASE ACCESSION NUMBER: Contig51749
  ref <309>: DATABASE ENTRY DATE: 2001-06-18
agtgcaaacaaacatttattgtgaaatattcatcctaccctttattaggtattacatcatcaaagcactttgtggcaatgaaaatagctttttttacccctctaattcacccaatattccattaaagctgcaaaaaatgtgcaatctgcttgaaaaataggttgctcttatttactcatttgtgaaaagtcaaaaattaaaaaagaaaatgatactagcatacagggcctctagagccaattcacctttccatttcccaactactccccaaaataattaacaaagataatttgttttaaatgcctttttataaaaccaatgcacctttccccatattataatcatacaaattttaaaaagccgttatttactttcttggaaaaaaggtggccagccgttgttttttgattgggagcatgtgtatttcctgggagttcactttctttaactttatgctccggtttttgatgggtttcctaaggggctctgcatttcccatggactcttccccttggctgttgatgtcatagccctgaagcacggagtcttctcttttgaaggagaagtttttggtggacacccctgagaggcctttgatcttgccacagaatatggtaggcacagcatcttcgacagagacaatgaccttggccgcctgggactcgcccaccatctcaatgttattttcagccttgacttcgccgctggggtggttgggctggctgagcatctcgg

SEQ ID NO: 2487 - DNA, 652 bp, Homo sapiens
  ref <308>: DATABASE ACCESSION NUMBER: Contig51775
  ref <309>: DATABASE ENTRY DATE: 2001-06-18
gcctttaaaatcattttataaagaatggcacaagttggggtttatgtttactcagatgaacccgtccccttagaggacacaatcccacccccaacccccccaactccacgactgcccatcattgctgttaatccttcaggggagggttcacagctgtttatgaagccaagagaggttctgggcaagatcacagctggggaaacaggcccaggccctgctccctggtgtcctccatgctggagtcagcggtgcccaatgacggggtgatgtgatcacatctgcttccttctccacaacaagagcagggctggcgggcaggccaggaaagtcctccaggatctgatcttgccctccgactgaccagtgcgagcgacttctgcttctcttgggtcttctagtggtagaagacagctggagctggggtggtatttggatcaccccagacccaagatcagtggactggagcaccatggaaatgtttgggagggtccctcaggattgggactttcccctgaggcctctaggctcctccaagctgtggcctcaaggataagagagattgtgtcaggttcatgtgtctctggaactgcatgattgctgttgagtctgtatgtgtttcacctgtgtatggatatgtgtctctgatcagatt

SEQ ID NO: 2488 - DNA, 1071 bp, Homo sapiens
  ref <308>: DATABASE ACCESSION NUMBER: Contig51800
  ref <309>: DATABASE ENTRY DATE: 2001-06-18
acttaaactggtcttgtagtctttattgactgtttgtaccaaattgactccaggagaaatggaaaatctaattagatctataactcttcaagacattgaaattacagctttaaattttacaataaagaatattctggccaggcatggtggctcacgcgtgtaatcccactgcactccggcctgggcaatagggcaagactccgtctcaaaaaaaccagaatattctaggctcaaatggtattacagatgagtctaccaaacattcaaggagcaattaattccaatcttaaattcttcaaataataattaaaaaaaggctgggtggtaggcacatgagtggacatattatttgttaatccttttgtgcataataaaataattttttttttttttttttgagatggagtctcactctgtcacccaggctggagtgcagtggcacaatcatagctcactgcaacctctgcctcccgggttcaagtgattctcctacctcagcctcctgagaggtagctgggagtacaggtgtgcgccaccctgcctggctattctttttgtatttttagtagagatggggtttcaccatgttggccaggctggtcttaaactcctgacctcaagtgatccgtctgtcttggcctttcaaaatgctgggattataggcgtgatccactgtgcctggcctggtgtttctttaggtataatgtctttaccagagagctaatgcagactgtcatgggtgagattgttctctgatgttcaattcccctactttgtatattgagtcagtatgagatgcgatttgtttggcaagcacctttgttcctgctgttactgacccttatcttgtagcctcacagctactatgcttttgtccagtccaactagataggagcttcttcctctgctgcagtgactggtctcacccagggctttcaggaaggtgagaataagcaccttcctcctcccaggaagttttgagtttcctgtgtttcatttctgaatgtaatgtctccatttattttcaattatgtttgattatatttgattaaaaacaataatttttttggc

SEQ ID NO: 2489 - DNA, 689 bp, Homo sapiens
  ref <308>: DATABASE ACCESSION NUMBER: Contig51809
  ref <309>: DATABASE ENTRY DATE: 2001-06-18
gactcttccctcctcatttattttggaatgtgctagaaacagcttgaaacatccctttaatagcttcctggcctcacgagtgttgaatgacatgacgaattctccttcatagaaggtacaggtgaaccagaactggaggggcatttgggatccttccttcttcagaaagtgcgatcgcatcaagatgcatgtggttttcagtagaactggcccatgtttcttgggagcgaggtgtccaaaccactgttcatccatatttcctgaatgatttgctccctgcgctcaatcctttctgcgagctctgcagcttctatggaactgtatataggatatgaagtcctacagaaccccgacagttcccctgggaaatcagactcagaggggtcctcctcctcttcttcatcctcgctgtcctcctcgaccttgtcacttcctggcaccagctgctccctccccagctgcaagtcgcggaagtccttggcacaggactctctgatgaccagggcgcacagtgtgagggccaggccgatgcagacactggacacgaacagcagggcagctctctccgggtgggctctaatgtaagcaaaggctgccagagagttgctaacaagaattccatctttcctcagaaccttcgatccgcttgggtcaaagtttataccatattcaccatctttctgcttcaa

SEQ ID NO: 2490 - DNA, 1307 bp, Homo sapiens
  ref <308>: DATABASE ACCESSION NUMBER: Contig51821
  ref <309>: DATABASE ENTRY DATE: 2001-06-18
ataataaaataattattttaatgaagtatttggaataattttaaacatctgatcagtaagattatacacaaatgagtatgctgcactttacaaaaaataaaggtaagcatttaaatataaaaaaacaactttggataaagatctcttcttaaagtactcctttaacatacacataatttatagcattttacataacttgctgaagcaaaaaaaaatgtggccaatttaaaatttactatactgtagaatatggccataacagtcccaatgggaagaacaggatgaagaataacatacgtgaggtgttttttttttttccttcaattcttataagtatagcatttcccatttttgaaataccttcttggaggattcaatcattttttttctgtatgtgattctaactacagtgattatttttcaccggctgtattccacacacgtggaattttcttttttttttttttaaagagggtttgctttgtccgtcagcttcttcctcaggtgaacacatataacttgcttctcatatttagagctcatatccccaagagtgagatattgacagtaccttttaagtacagaatccaacataaagtcctattgttaaaaatttctcatcatcaattaggattttttaaatgtgccaacatgcttaaaaattaggataactaaaatatattatgacagaaggaactataaaaactatccttgggatttaaaacaatacaaaacaaaaaataacattttccttttgaaatactctaatttgaaaacatctggtacattctcctttctggttgtgctgtgatttttttttgcccatcaacaaaacatgtaccagttgttttggagttccgattccacctcttcccctcttgggcatatgaagcacatttcctgttttatgataccattttcacattctcctcatcagtttgaaagcaacgccctaacgttccttctaatactttgcaccttttccattttttcaacaagatatatcagtagattcaattttaaggtttccctgacaagcatgtcccctcacttggtaccagaaacggcatatggtgatatgaagcagagaattagcaaccccaggcacaatctatccccatttgtcttgttttgacaacactggaactcagccgaccaaagtcaccacagtggcctgtcacgtacagagggtgactgtcatagttagctaagcaacttctgattccagcccagaaaacctaccactttgggacaggttcaatatagaatgaaatagtcattcttgtattttcttatgcctcttcctt

SEQ ID NO: 2491 - DNA, 442 bp, Homo sapiens
  ref <308>: DATABASE ACCESSION NUMBER: Contig51888
  ref <309>: DATABASE ENTRY DATE: 2001-06-18
cattacttactcagttttatttaggtggacacaacagtgaagaactcaaacatggtttgacctttatctacagacacagcagcctggattttcagcctttcattccttttaaatgaaagtcagcaggctcaaaatgcagagcttggctaagtcacttctgtggaaatatgaaatatagtagtgataaccaccaagggctttcaaattcttgtgttcttctaaggatcctttcctaacaccatgatttgttctcatctttgtggaaatgaaaccaagatggtcttaatttgtaaagtcctttttcctctgttggcagtcttcttacaaaggatgcagcaaaaagaacacatttttctttcaaagttttgaagaaatatagtcattaaaaagaatttaaattatgcctagagcaccactttacagaataccattaaattgtaat

SEQ ID NO: 2492 - DNA, 1156 bp, Homo sapiens
  ref <308>: DATABASE ACCESSION NUMBER: Contig51929
  ref <309>: DATABASE ENTRY DATE: 2001-06-18
taaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttggg

SEQ ID NO: 2493 - DNA, 615 bp, Homo sapiens
  ref <308>: DATABASE ACCESSION NUMBER: Contig51953
  ref <309>: DATABASE ENTRY DATE: 2001-06-18
aactgttatcagactttggtttattgtaaaatttagcaaagtttttcttgtaatccctgacccattgctctgaaaacaaaagcaaaaacataattattgcttattcttttccccctactttgtttgtgctactgtaaaagaagggagaaaatcattgtaataaataaaaaatagagatgtaacagagaaaaataaatcagctcagatgagaagtattaggagcaacagcaataccattaagcagtttcaaaatcagcttcttttaaaaaggtcatcttattaaaataaaaatcacaccaaaaatatagcagcggagaagaaggataaatacaagttcattgcacaccagtcccatgcaaaaaactgtcactagccaaagcagtagtattcagaatccaatttaggacgcttgtgtagtgcctgtgagtcctctatgagggagctgtcactgaattggtccaagtctgaaggggtctgatggcctgggacatcatccgccaacgtgtccagataacttcccacggaaatgccatccagcccatcactgccatcgtgtaggctgttgtagctgccacgtaaggaggtgctctgactctccaacaaactgcacaggct

SEQ ID NO: 2494 - DNA, 1270 bp, Homo sapiens
  ref <308>: DATABASE ACCESSION NUMBER: Contig51963
  ref <309>: DATABASE ENTRY DATE: 2001-06-18
cttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattctgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacactatcttacagcaagtgaacaggggctacctgccacatcccctccacagatgcactttaaaaagccactcaagctttggcttaaactgtaattaatttattttatgtacaataaatcgca

SEQ ID NO: 2495 - DNA, 1207 bp, Homo sapiens
  ref <308>: DATABASE ACCESSION NUMBER: Contig51967
  ref <309>: DATABASE ENTRY DATE: 2001-06-18
tctttaaataaaaaatccataaatttattgcaaatctagaagtaccagaatgtcactaatacagaacagatcagcaatcttgtttgtattttcttccaaacatttaaaaccttgattattgacatactgaaattggcatacattttgttttcatgcagataacagaatagacatggagcagatccctcagaaatcagttataaatattaaattgtattgaacattcatagtaaaaaatatgtcgtaaagtgctgaagtcatgtaagtctgcaaaactgccacaagctcaaagttctcaagcagtgacagagatttgctacatccaccttgttttagattatgcctgtttttgacagacactttgtcatttcctcccccaccctccccaaagttttatagattgtcctatttctatggctgataagatgctctacaaaatgtagcaggtggtgatgaactatgccactttcatttcagtgcagagaaatattcaagcttgtgtgtacctgtaaccaaactaggcttgttatgtttttccccctgagttgtcataaattaacattaacgatgaataaagatggagcagcaagcattgaccatcacctgcagggtgagattgtggtaaaataggtgagtaaaaagtccacctattatcctgacacttgccctccttacagaaaactgctaacgtgagcaatactatacatgtagtgtgactccaaaaaaaaggaagaataaaacaaacaaaacaaaacaatgaccagttacccgatacctctggcaacttagaccaatcaagtcatgtgttatagaagatgtaaattgcaacttgtaactcgctataacataattgtctctgttacccccatgtgaaatacagaaatgcttcaataattagatggttttttctttaaatcagaaatgctttaacaattctctgaaatataattctgatcaaagaagttcctcaagtattcttaaatgataaaacaaattagttttgaaagctaaggcgatttgcaatccattattttttcccctttaatagcacacgttgcccctaatcaaatggaagaatcatgacaacttggccttttatgaaagtatttttacaagataagacgtattctgtgaggcatttaaaggattgcagaaaggaggtaaaaatgctgcttatgtctcagattttatttcttttgattacttt

SEQ ID NO: 2496 - DNA, 622 bp, Homo sapiens
  ref <308>: DATABASE ACCESSION NUMBER: Contig51981
  ref <309>: DATABASE ENTRY DATE: 2001-06-18
actgtaggacttatctctttattacactaacatgcactgtgaatctctaagaaaaagacatcatgtgtaatctcttccaaagcttattttaataggaagtctttatgcatggcatatgtcaagattaatggtacatggaacacattttgtatcctatccatgagtcacacgggaaatcaccttccaggcctttctctgtgaggtctccctgtccactgtgccctgatcaaccctccaccccttcactgtctttacttccctcatttcccttaagcagacaaaagtccaggtctctggtccacagcttcagacatgacaaggaagaggcccagtatcaaggtgaagctgaggaaggccaagggaaagccaggccaagaggcacccgttggtgatggtcacaggagagaggtgatcagtggagccaggtactgggccatcctgctatagatcacactgctgagttttggttgtatttgttttagaagcagccatcattcaccgagggggagagaggaaagggaagagaggggaagagaagaatggggagggatatttacacgtgtgaagcaaaggccaagccagaggctgaaagccgccaccccctgacaagcctccacctgct

SEQ ID NO: 2497 - DNA, 609 bp, Homo sapiens
  ref <308>: DATABASE ACCESSION NUMBER: Contig51994
  ref <309>: DATABASE ENTRY DATE: 2001-06-18
caaagcgcgctcagcaacctcggctgtatttattgatacaaggaagatcacccgagagtcagggacgtggcggcgaggggccctggaaatctccagataccaaagctggaagggcgtggagtcttctccagttctcctagtttacagatgttgtgacctaggcttacaatgggcctggggtctgaaagcgggacgtgggctgcgggggtcaaagagccggtttggtggaggtcagcgccacagcgcgccgtgccaggaagactttattctgcgcctccgtctctctctgacgtttgagctcagagatgaggcgtccgtaggagttagccagagccacagtgtacgccatcaggatgctggagatcagcagaaggggcacagcaaaagcctgggtccccaggaagaagaggaaattctgggtggtctcagggaggctggaaatagactcagggatctgggcccagatggacgactgcccccggaatggaccacaaagcttagaaggcgggatcaggaagatgctgtaaagcaggggaacgctggagatggccagacccaggagaaggaccaaggggaaaaagaaattcgccgcggaggcccggaaggtgc

SEQ ID NO: 2498 - DNA, 661 bp, Homo sapiens
  ref <308>: DATABASE ACCESSION NUMBER: Contig52082
  ref <309>: DATABASE ENTRY DATE: 2001-06-18
gcctttacagatatgtttattagacacaaagagggttcatagatgacctaggtcaaaggctagaacatgcagacatacttttaagaacaataaatttagaaatgctttgaaacaaatgacaaccacagatataaaaaagtgctttttaatttttagccagaatggtcaagttgatgtagattttttttactggaatactcataataatgtctgtctatatgccttaagcaagattattatttaataaaagatggcaggaagttgtaatttatggaaaatttacaattattctttaaaatacttttataaaattataaattgataataatccccccaaactgaagtgaaatacttttaatactacttgaaattaaagtacagttgtttatacaacaatgaataaggacaagatatcaaactgaaaattcaaaaataaacagaagaaatgtaaacagttctaaaatatcagtatttataaatgttgcttagaggaaggctattcaaagcatggtccattaactatttgtgagctgtccagaatgaaagaggcttgtgccagaatgaaaatcaattacatcactaatcatactggctcagttgactttttttaaataacaagacttctttgataaaggaagcaatgtgttgatttatattctgg

SEQ ID NO: 2499 - DNA, 514 bp, Homo sapiens
  ref <308>: DATABASE ACCESSION NUMBER: Contig52094
  ref <309>: DATABASE ENTRY DATE: 2001-06-18
cattagtactttttgatgtcaatttattatttatccctttgccagtattcaaacagacaggcagtcataaaacattaaaaaagatcctttaaaacggtcaggcatctgttttacctcagttcctttttagaaacctggaaatcaggagccccggcttttatgctatagcaagtttgacacttgctgtatcaaaaatattgcttgaggatcactacgtagaaagagttttgtttaaattttatgaaaggctggttaggcaggcagacaatggtttctaaggcaagatccagtgtaaatcagcaatgtgctgtttccaactgtttgactcctcagttcatattctgaaaccagggcgttgacaaaacccactgttcagtaattagcatcctgtcaaatctttccaatcaagactagcatgctgcacctggtcctagttaaaaaacacattgtgggcaattctgatctgaccctcaggggccgctgccatgctcagaactgcattcagcgtgcatgc

SEQ ID NO: 2500 - DNA, 1284 bp, Homo sapiens
  ref <308>: DATABASE ACCESSION NUMBER: Contig52320
  ref <309>: DATABASE ENTRY DATE: 2001-06-18
gcccattcttcacgcagtgtccacgtgcgtctgtctcgtggatgcaggttcctgttttgtagtaacgcaggtggtacttgcgttctgtgtcccccgtcgtccggtgcaggtagggacacagaatgcacagtggagacccagctaggcacaccccggacccatccagacaggagttctgcacctgccggacgacagaggcctgtggaggcgcacagggcaagcgggaagtgtcaggtctgtcaggtgacaccgccaaacagagctctgtgtctgtgtgtcaatctggaaaagtggcaccacaggaatggggcaagcctgttttttctgagaacgagacccagggtggctgcagggccacagtgcaggagcgctcttctggacaggggtgggctggcagatggccactcgttctgtggctacacagctgcaggccacgtgtatttttttttcccaatgaaaatgggcctagaggctgggcatggtgcctcaggcctgtaatctcaggactctgggaagcctagcgatatggatcgcttgggtactccggagctcgaggcaggagaatcgcttgaacccaggaggcagaggttgcagtgagccaagattgcgccactgcactccagcctaggtgacagtgcgagactctgtctcaaaaaaaaaaaaaaagaaaaaaaatctttatctggatctgttaaaccatatattattgatcattgcaagtgaaattttgagagattgtttctagtatttaggtgatgaaaacatttggtaatattgctttggttcaaagaattttatgtctttatctttctagaagaaagcaattatatatatatttttgctaaattacataaacatttaattacatcaggttctaatttaaacatgtattactcacttgaggccacttttaaatattcatactctttgacataagatgctttgtatatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagactta

SEQ ID NO: 2501 - DNA, 930 bp, Homo sapiens
  ref <308>: DATABASE ACCESSION NUMBER: Contig52398
  ref <309>: DATABASE ENTRY DATE: 2001-06-18
agtagtgtaaatagtttattatttgctcatatgccatgaaaagaccagaaaagtaacatgaattgcttttataaaacattctaatattgctaagaagcaggcccattaatagacaaacagaaaagaacatgccaacgttgtctatttgtagattaataaataggcaattattttaatatacatatatgtcagcattgaactttggaaaacagctgctttgtagtggaagtccaacttggtcaaattgctatttttaatcgaagtgaatgttgagtccacagaaagacaaaatcgtggcatgttctttttaaagtaaagtacacatttatgggaatgtgcccgcaggtggcagtttaatctttctgtaaataggtacactaaagtgaaatgtggtaggtaacttgttccctaaactgtccttatagttaaatatatatattaaaaaaaactataagttaaaataacattcagattgtatagcataggctgatgcattttaaaacaatatttacaatattacccagaggcttaggtgggaattaaagagaagtgtaaaaaccataaaaaactgcaccgattttatagcaaaatatctgtacatttaaaaagatcatataactacacatccaaggaaaagggaccttcaccaaggggttcacataagcacaacataaaataggaacttcagcggttaaatactatacaataaactttacaattaatatattgatgtaccaagaagataagccagaagcagaatgtatattatgaaaagtacaaatttagcttcagtccagtttttgactttggaatggatcaagtgccctgccagagaggaaggaaaataacagtggcttagtgggccatctagtcccattacgtattatttaagcttaataccatgttaatacttttcagcaacttaaactg

SEQ ID NO: 2502 - DNA, 572 bp, Homo sapiens
  ref <308>: DATABASE ACCESSION NUMBER: Contig52405
  ref <309>: DATABASE ENTRY DATE: 2001-06-18
gggtttccacaaaggcttttggttttattattattatttttaacaaacatacattggaaatagtaaaggtttctaattgaaaagagacctaatgcatagtttctctgcagcatagaagaccacctgtttccaaacttcaaggttagggctttgaaacattccctggtaaattatctccagctggctagctagttaggcatattggtgcacattggtatcaaaggtgattattttttgcatttagcaaatgagcgctattacttttttgatgtatttttaattcagattgctcaaaagtcttgttatttcaagggagccttatgtcataccacaaatattgatacctcctagtggaaatggtggctgtgggctccctagtagagttaatggatgaaggctgagatacttagatactgcggacatcagggttatggagcaaagtgttatgaacaatagctacagagagctccaagtctcccaaagcaactcataactataacacagataaagttccaaagtcatttcatcacctatgtgaaaatgcaatactgaatgttttggctctctgatgc

SEQ ID NO: 2503 - DNA, 511 bp, Homo sapiens
  ref <308>: DATABASE ACCESSION NUMBER: Contig52425
  ref <309>: DATABASE ENTRY DATE: 2001-06-18
aacagtttttcacaacaaaatttattagaagaatagtggttttgaaaactctagcatccagtgagaactaccatacacaacattacagctgggaatgtttctccaaaatgtcatggtcaaataatacaatggaaccattaaatcttacacatgcacgaaagaacaagcgcttttgacatacaatgcaaaaaaaaaaaaaaggggggggaccacatggattaaaattttaagtactcatcacatacattaagacacagttttagtccagtcaaaaatcagaactgcattaaaaaatttaatgtagtgcaatcaaaccaaaaaacttaatttgtgatcataagtgctctactacataaacattgatcatagcaaggaacaaaaagttcaaatcacacagtacaaaaaaatctgtaaataaatataaactacagtacaagagaaatattaaattatacaattccatcaaactgtaaacagtatattgaaatgaggtccataagagtaaaggggg

SEQ ID NO: 2504 - DNA, 842 bp, Homo sapiens
  ref <308>: DATABASE ACCESSION NUMBER: Contig52482
  ref <309>: DATABASE ENTRY DATE: 2001-06-18
ctaagatgtataaatgacttacttttaataataaatatttcttgatttataatgtaaatacaattaaacaaatatgggttactcgaattaaaaaaatggcacatgtaaatgagcattttagtacaaataattaaaatgtatttatattatatagaaatctacacaatggaagatactactaaaatgttgctctacagcacatcaccctagacaaaatagaattctagaattctctttaaaaaaaaaaaatcactgagaattagatgatgactgtgaaataggttctcccattacaatactacttctgtcattcaaagttctgaccacggttgtagctggcgactgaagcacttttcgagaaagcctcattcttccatcggctgggtcacgtccaaagtatttcacctgaatttcttggccaacttctaatcctagggcagtaggatgtttaatctttcgttgatcaagttgtgtgttatgaagcagtaccgcagtcatatttggatataattttaccattacaccagtatctctgatttcagttattgtggcggtatatactgctccaaattctaattgctgctcctgatcatccttgcagatttcagtaatgaagtctcttgcctcatgcatagcactgggtgttggtgcaaatacagaaaacgtttcttcatccacctgactaatagttacacctgtttcagcctgaagtttttttaagttatagccaccaggtccaacaaattttgctcgttttgataatggaacctgaacagtttctacaacaggtccattttcttttctagatgctcgaggttttgaaatagttttgttcatgatct

SEQ ID NO: 2505 - DNA, 518 bp, Homo sapiens
  ref <308>: DATABASE ACCESSION NUMBER: Contig52543
  ref <309>: DATABASE ENTRY DATE: 2001-06-18
caggatgtgacaacgtttttaatgcaaagtcaaccattagcatctttcccatgtacttattagatgtgaaatggcaggacttcacggccccgtttgcatattttcctactccgcagacgaataatattttcagggaaggcagcgcagtctgtgccgtcacaatcgggcgactgtgggtgatgagggatgatgattttccaggaggccctggggtcagaggactcctagagggagtttccagcccctcaatcgcagatggatggcctgttgatgttgtaactggggtggaagttgagccggtcacaggaggtgatgcagttatcggggccagtcacgatgcttttctccaggtaaacattgagagtattgttccggaacattccacccgctgcaagttgttgggaaaatttattcgaatttggataaaatactttaggcatctcgtgcacggtgggggctctgctcccgtaagcctggttactggtcctgtacacggagacagccttctgggtcctgta

SEQ ID NO: 2506 - DNA, 430 bp, Homo sapiens
  ref <308>: DATABASE ACCESSION NUMBER: Contig52553
  ref <309>: DATABASE ENTRY DATE: 2001-06-18
gcaataaatgcccatgtttattacaagatagaaacattaaagatttcttaggcaaaagggcaacaggtatgaaagtattcacagggcgccaaatttacaacagcttgctccaggcgatttacgtgaatcctggcctgtcccagcatgaggccattgacaacctggcgcctctgccaagcctgtgtccaggtgcctggcatgaccaggcgtgatgcccaccaccacagtccctgctgcatctcagaggccggggacctcccacacaaggatctcgttgcgggcggccgtgaagagcagcctggcggacggtgtaaacctgcacaggtgcactgcgttgtcgtggccggcaaagtcttgggcagtccccatggcacagtctaccagcctcagcatgcactcagcaaagccaacagccaggaggtgggtcccg

SEQ ID NO: 2507 - DNA, 958 bp, Homo sapiens
  ref <308>: DATABASE ACCESSION NUMBER: Contig52579
  ref <309>: DATABASE ENTRY DATE: 2001-06-18
ggcttaaaagatatcatcaatcttttatttaactaagcactgcccttcattttgaaggaaatgatacaatttcaaatcggaacttccttctcaagaagtgatataagaatgtaacattgatttaacatacaaccttcaacaaaaataaagtttatacaactcactgggaaataaaatgcatgtggaatttatcctgtttgtcaacataattcttcatgagtcacaagtattatagccaagaacaaaacaacaaaaagctgaatcagttgatagttactctgatttaaaaaacatttcacaaataagatgtagctttccaaacaaatccattcgatgaccattatcacaactatattttattctaatttataaaacaaaaaatggttagacaagcacatgatatcaagagtcttcaacacagtggattccattttattaagaaaaaaaatagaaaacaagtagtccttaaattgtcttagctctccatagcatacgttatataaaattaaagttttgcttccaaaaatatgtttccatgtggtcgtggtgttgtccagtgctattagggccaaagcaccaaagacatgagaagtttaaccatcgacttgtcatttttcataaaaactaaacatttccttataggtctggagtaaaatcttctaggcattttagtgctaaaagtcactttaaattaaatgtgaaataaaagctacaaaaagtatgagttctttcaatacaaaaagttgtgtagctgaagttgtgggctcctttgacatacataagcagtttcaataaaatatttgctcaggtaagaaaatagaaatttgtctgctttcatttagcatacgttccagtcgatgtcctgcttatccctgccagaacttctgaagaacattagaatcgatatttctttccttcaaagagcatccgtaattcacagtacaaaacagttctacag

SEQ ID NO: 2508 - DNA, 636 bp, Homo sapiens
  ref <308>: DATABASE ACCESSION NUMBER: Contig52603
  ref <309>: DATABASE ENTRY DATE: 2001-06-18
gaggcatacacatctctttatttacaaaatgcggtgaagagaaaatatctagatatttgggtgtaattattccaaacatagaaaacacacaatagaatcaagtgaagggaaagctactgtaacagcttagatactttttaaggagaactgatagtaaatctgggaatgggaaaaaaacacagagctagaatttgtttagcactccgtgcaaaaggcaaaagctgataaaactggagtggacggaggctccgaatgtggccctccgctgctctctctcctgcagtctcatccccggccttagccctgacctctcctccgaagcccctggtgaaggccgcgatggcaaccacctgcaggacggcctccaggccgtgaagggccaggagcgtggcgctgagggcccagtccgcccacaacactagggcctgcaaagcaggaagtgggcagagaggagggcggtgccagccgtgagggccaggctggcggcagcggcctctcagcctctgtcaggttgccctggtgcccaggtataaccgaactgcttctagaatccccatcagaaacagcagagcaagatcgaggaccaggtagcggtgaggatagctgaacacctgacttttatacgtgatcatcagg

SEQ ID NO: 2509 - DNA, 640 bp, Homo sapiens
  ref <308>: DATABASE ACCESSION NUMBER: Contig52639
  ref <309>: DATABASE ENTRY DATE: 2001-06-18
aaacgttaatgtgatctttattatacagcacatctggtatttgtgtatcccaacaagtatacagaatactctataaaaccaaacccaacccttcaatattacactaatgaagattaacccagagtcgcatctcttcaaaatgcacacaattaagacggtcctgctgtaacaatattatggaaagagccaggtagcacaagaaaggagagaggataaagactgaagtgtgtgccaaagtcattgtcttttgttattgcacttttattctacacacttagtatcttacacttttatttaacactgtaataaacattagtcctttaaaacaaagaaaaaacattacatgaagacaaaagacaacaggctgcccagaccaattttcttttcaactatctgggcaaggtggcctccccagtgctagatgtcctgatgcacctctgagatcacctcaattggactggatgttaacaaaacagatgaagttaaaaatgaaacccttttaggaacagtagtgctactggaaacctccaggagagtttggaatacaagtgtctcaaggccactccctccttacccactttaacatcaaacaagctctattcatcccacctccataactgaaggattaaccttctttttc

SEQ ID NO: 2510 - DNA, 557 bp, Homo sapiens
  ref <308>: DATABASE ACCESSION NUMBER: Contig52641
  ref <309>: DATABASE ENTRY DATE: 2001-06-18
ttgcggttctgcaaactttttttaattttaattttatttttttacaatgtaccatgaacatcttttccatgcacatgggtgaaaatcctctactaaaatatagagcgccgtagttgggtcaaaaggctgctggtaacgagactgacatctaaagcaaagtatcagcttaaggttaaagcattgggcctggcaaatacctaccagggaaagcagggccagcaatattctcatcagagaaatcagaatggaaggccaaaggcattaaaggtatgggatatcgtgtaagcccctctggcccctacctccacccctcactcccctgacaccccgttgtccccttggggcgaatggatcctgtacatctctttgcatccaatgaaaaccacccattttctgttttttccttagctcctcttgagcccttgacacatctccacattctctcatcatctcctcactgctcagatgcctttcctgtaagtcctcctgagagtccttgggggaatcgtccgtccccctgtccgtttttctttttgctttccggggcacataatctt

SEQ ID NO: 2511 - DNA, 1098 bp, Homo sapiens
  ref <308>: DATABASE ACCESSION NUMBER: Contig52684
  ref <309>: DATABASE ENTRY DATE: 2001-06-18
gaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgcagaaataaaattctaaggggcgaaagtccaaggcagaagtcaaaagttttgcaaggaaaccgatgaggttgctgacctgagctgggcagggttgaacaggcgagtgccaagatcaaggtctctgattgtctctccttgaaaggtaagcagagaactagggctatcccataaattaagtgggagattggaaaggggtgcggacttctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggagcaaaaatagattttctagaaactgcagactcctgtgattggagcagtatacaaagtacagcaacatcagactagatctcacctgaggtgctgggtgagaaatcttagggaccagatggaagagggcctgtgtataaagacattaggaaggaggtttgggagggcagcctgacttgtctccagagaaagttagaactggttgacttagcaaccaagggacactgggtcaaagacgaggaatcaggacgtcggtgcctagtgactgagcgccagcccagcccatttctctacattgccatgggctaaacccagtgtgctgtaaactcttcagttcctttggttatggattttgtatcttttctgtgtttcttaataaagttcttttgaaaaatgggaacctttctcagatgggaattttgtatctttcctctgtttcttaataaagttcttttgaaaaattgg

SEQ ID NO: 2512 - DNA, 825 bp, Homo sapiens
  ref <308>: DATABASE ACCESSION NUMBER: Contig52705
  ref <309>: DATABASE ENTRY DATE: 2001-06-18
agttttaccatcttttattataaacaccatcacatttcaagtttcctctttttgatcacaaatataggactttttcttctcctcttaagtatacagcatgagacacagcgttggggctttccaggtttcttacagaaatttccttacgacaaacttagggttagcatccacagaccatgctctcggtcacatccttcgacatctggattgcccaagacggttgcacaggatgcagactccaaagaggatgaggttggtacataacgttttgaattccaggataacctgaaacagaggcccctccactgcccacattaaaaggctgcacaaccaggagggcgccactttctgagtgtgggcttagagctgctgctctcgggctctagccccacttcttgtttgaacacatggctcaaggtttccctacgggtggaaaagatgaagaggacactggaggttaagaacccagcaggccgagcagtggcagcaatctccaccggaggcccggcctgtgcttcccctcctgggatggggtgaatgggggctggtcaggggtgccagatggtggtcttatttttacttgaattattctgcattttataactcaaggttcaaagctctgtgctaaaactagatcggacctttccaatttcttagaaaggttcctcgaattcagattcccaaaccaagtattcagctatttaaaacctatctgtgaatgtaagggcccaaacggaagctatttggggcgtgatttctaaaattaccatcacccccacctagaccagcctttgttgggggactagggataaagtgggttctctg

SEQ ID NO: 2513 - DNA, 510 bp, Homo sapiens
  ref <308>: DATABASE ACCESSION NUMBER: Contig52720
  ref <309>: DATABASE ENTRY DATE: 2001-06-18
gcctttgtcacaaatctgaatctttattgttctgaaataaatgttataaacataactcaaaacaaaaacttcaatattcagtctaagaagaggtgtggctcaatgcccatcacatgtaacaagaaaaacctcctttaaaaaaaggaaaaaaaagtactatgagaagtctttcatatgaatgaaaatgcacccgttggatttttttccccctcatcacattagcttgtatacacgtgggaattgaaaggtttgcattttcttcacatagttcttgctatgatgtctgacggactttttgccactcaacaaattcatcaagaagaacaggccaagcaccatcttcatcatagttactaagatcagcatggactgttctgctgaattctaatacattgtaccattgatctttgttcataacacgatactttgattgctccaggtactggtaaaatactgaaaacagtggccatgtcctcccaagcagaagagctaacatagatttagcagtat

SEQ ID NO: 2514 - DNA, 517 bp, Homo sapiens
  ref <308>: DATABASE ACCESSION NUMBER: Contig52722
  ref <309>: DATABASE ENTRY DATE: 2001-06-18
aacaattattttttcctcatttctctcagtaaccgcactaatgacttttaagtgccagcaagctgcaagtgctgccaatgagcccctgccctagaagggctacagttgggcaccatgtgctcaggggagggccccatggcagtcagtggagggtgggaagctggatggccctggccactcagcccagatagcaaggagggccttctcctcccaaggactcaaagtctcagaggccggagaaaggtgggggatggtctcccaggaagcagaatgctagaaggccttgcagggcaaacctgacgggccttcagggcacctgacagggctgggactgccggcttccctcacttctctcccgagcacaagaaaaccttccagcaggagccaggtgggcctgaggctgtgaggctgtcactcacttaccaggggattcaggcaccttgaacatggctttttcttgaagcagctgctcaggttggttcttgttgggtaggtccctcatcatctgcagctcctc

SEQ ID NO: 2515 - DNA, 834 bp, Homo sapiens
  ref <308>: DATABASE ACCESSION NUMBER: Contig52723
  ref <309>: DATABASE ENTRY DATE: 2001-06-18
atcttcaaatttaaatttattaagacattcagctatgtctgtcagtctacatccaaatttgctactaaaaataaaataaagtcacatcccacattaggaataccgaggtctgaaaaacactttttgagccaagcctattgtataaataaatgactagtttcttttcatatcaaaattcccataaaaaattacattcccccctccccagttctacctgtagccatgatgaatgtaaaaatttaaatatgacacatccttgtcaaagaaaaggtgcaaagtctattaacagctttaaaagtggcatttgcagagtgtgatcatacagttatgtactcattcccaaagtgcaaatattgccataatttaacactgttttgattcagttgcaagaattaaacattacacaggattgaaaagtacacccagggcctctatcagtgccctaaagcccttcccactttggtctccttcactaaagcagactccaaagtgttcatcagagttttagtttacttcacacagccagcgaagtatacaacatatttaacaaaagtttcatatacatcaaaatattgaagactccgtcataaagttcaagagtctcagattacatgaatgcacccgcaaggcccaagtgcccacccaccccttccctaaagcacatacaaagtatgagcgtgcttcaatctttgaatacaatcaatgcttcttcatctttgatttcatttcagtgctgtacaagactcaataatcacctgactgagctccaattaactgaggagaaacggggtggaggagagggctggttgctattcagacttgataatgagattg

SEQ ID NO: 2516 - DNA, 437 bp, Homo sapiens
  ref <308>: DATABASE ACCESSION NUMBER: Contig52740
  ref <309>: DATABASE ENTRY DATE: 2001-06-18
ctggtcccacagctgagtttattatacttgttttcttttacaaaattaaaaacatctaaaaccaggcccaagtggcagcttgagtccctccatttctggaaactgagaaggctccacctggcttgatatggacacagggtgtggggtggaggggaggaggtatggtgcccgaccaaggaggcaaggggcaagggtggcagactgaggagggagcaccgccacgagccacagtccctgagttataattcacagtaagaaggctcaggctgcagggggaggtcaaggctcagtgaggttctggggtgaccaggggtttccctggggaaggtggccggggccaagatgctctcgagccagtttagaggccagggcccttcctggccatctgtcccgtggcctagccgacactccgttcatctcacttggtgctctgggtt

SEQ ID NO: 2517 - DNA, 457 bp, Homo sapiens
  ref <308>: DATABASE ACCESSION NUMBER: Contig52779
  ref <309>: DATABASE ENTRY DATE: 2001-06-18
taaggacagcaaaaatgtttatttgaaaaaattactatgtattgaaaatatacattagaaattattacatacttccatagcattcccctcccacaccacaaaagtagaaatatctgcttactatgctaatgccataggtaaattcaaacaaaaagtaaatcatcctcagtctcctttactcaaacactagagctgggggccagagaaaggtcaacttgtatctactaatcaataggaatttaacaagtcccagtcttccacagcaagacatacatatttctgctttgaaggttgtgaagagttattctgttctgtctctgactcctcaaaaggtctcttcttgctcttctttgactcctggcttgagatagcttcgtgtttcaacactggcccatggcaatctggggctttctctttatagaactggagtttctcggaagagttcatgtgggtgtct

SEQ ID NO: 2518 - DNA, 600 bp, Homo sapiens
  ref <308>: DATABASE ACCESSION NUMBER: Contig52957
  ref <309>: DATABASE ENTRY DATE: 2001-06-18
tagttatcatacatttatttttaacatagcaccccagtttcacatcatgtatattttccaaagttggagatctttaactatgttcttcacagacctttcaacaagtgtgaaaaagaggcagtaaggttagcttgagtctacaagtcacaatccaaatataggacacctatgtttaaggtcaatatacataatgttcccaatgcttagcaaatgaatgagactctggctgagtaaaatattaacacaacttgttagcacattatcatgaaaagacagaaggcatcaaatatatactttgctgttacactttttactgttcaatgtacttgtagtgaaaaaatatacatttttactttcaaggttaaaatagaccatcagctcattatctctcttagccaatagctatgaagactaaaatggctcttcttgcttctggctcacttgaacatcttatttgtgctgaagacaaaaaggatagcagtgctaaagaaaagggtatacccggttcccaagataggtgcggttgaggttctcgcacaaggtgacttaaaacaaaaataacacaactcagttgatccaatctccacacaatggggttgc

SEQ ID NO: 2519 - DNA, 708 bp, Homo sapiens
  ref <308>: DATABASE ACCESSION NUMBER: Contig52994
  ref <309>: DATABASE ENTRY DATE: 2001-06-18
actgctttcttgattttatttcaaaagtacacaaggtcacaaaactagagcaagttgtttttcttaacaaattttgttcttacaaatttcaaaatctgcaccattggatatataagccagaaatcgtacatacaaaatctgaaactgacactgtcagttctatactttgcacacgtgaagtgtcagaatattttcttcagtagtacaggtgtatttatcactaaaattcacaattagggaaaagaataagtgaatcaatgaattgtggttctcttaaaacttgtgtcattaaataagttagcagaaaacacaaagttctgttttgatggagcttttagtctcgatgaccaaaaccaaacccaactgatatgtactatattcttaaattataaaataagataaattataaaagttaaccataatgaataagaggctggggttatctgctataagataaatgatcagccttccctaaagataaataaactgaaccacaattcacaaatgtgtttattattcttccctgcttctataacatttataaaaggaatttgtgctcagttgtggtctattttagtgttaaaataggtaaatgagtaagaaatcctattgcagaacatgatgcctttattgctggaatatccaaaggcattcaaaatattaaaacttgcccagaacatttacactactaaacacaggaatgttata

SEQ ID NO: 2520 - DNA, 911 bp, Homo sapiens
  ref <308>: DATABASE ACCESSION NUMBER: Contig53022
  ref <309>: DATABASE ENTRY DATE: 2001-06-18
gaataatataacagttttattataaatcaaaacaccaaacttttgcaaactttacataaacgtgtagccatatgactgtataacaagagcccaagagcaaccattgtctaacaggtagaaatgcagacagtttcatgttaagcctttagaatttcctttcacggcaggtttccaaaataaactaacttttctaacatttattctcacaaaaatatatttcaagttagaataaacaactcattggcttcagacatttaattgtatgtatttaaccatactcagataattgtcatatttagccaaatggaggctttttctgtgacctatttccaaattctcagattctggttcatctactccttcaagcagtttggaatgacttgccagttggcatttatatcattggaactattctgcaaataagccattttgataaagcttgcttggtttgagacaactatgtatttggagataaaagactcagaacaaagtgcttgccttttctacagtttatatcaaacgagatgggcacttaagcagtcagcctggattcatatgtctagagtggccaggctgtaaatacaataagtctagctgccttccacatgtggtcagacagctatattaagaagatctactcactgctggttatgaagatagccaggagcttgtctgatttaaggaactattcagccattgaaggatagacactcccaaaaatggaatttcagggaagtgtagaatgaacaatcctgttcaaagcagccaaaattattttctgcatgccaagatgttattcacacacataaatactatatgcagataatcttcatttttgaattacaagttgttttattgcaaaagcaagtatagttataatatatagcaaagcgaatctatctttggttcta

SEQ ID NO: 2521 - DNA, 519 bp, Homo sapiens
  ref <308>: DATABASE ACCESSION NUMBER: Contig53038
  ref <309>: DATABASE ENTRY DATE: 2001-06-18
tgatataaaataacttttatttacataatttatatatatatataactgctttctttagaacaagaaaatttataaatgacatgatattgctttttctgtcaaagacttcttcaagcaagatagtatacatggtcacttttgtttcaaataacatgatggtaaacagtggatattaatatttttgtcatgcctcaaccatttaccaacaattaggcgttcaaatcctcatgttgaccacttgctaagacataagtgttcaggagaaaaagtcaagaaaagataaaaacttttactcatatctcctttaaaatttgtgaaataaatcctttgcaacatcttcttcacatgaatcagacctaacatagttctttccaacatgtaaggtaaatacattgattaactttctcttttccaaaattaggtttaaggatttaacagtaggatactttagctggctgacttgattctctaatacaatgagtctctgtattctttatatagtaagaaattccattttcc

SEQ ID NO: 2522 - DNA, 478 bp, Homo sapiens
  ref <308>: DATABASE ACCESSION NUMBER: Contig53047
  ref <309>: DATABASE ENTRY DATE: 2001-06-18
ttgtaaaatagtcttcccttttattttaaatcaacccttttccaagttagtgccacgagttgagatcagggggtcagagcccactgggatgtggcaggggcagcagggggactcatgtcccccacccccagcttagtccctccaaggatgggaccggcagccagggatgaagggtgcgaggcgaggctgtctgccccctcccctgccagccctactccctagtctgccccctcagctactcccaaggccaaggacagaaatgggagcacagtggccaagagcagggaggcggtcctgtgcaggctgtccatggccaagagtgttagtggtcagagcccaggcaggctgggttagtggggtctcctccggcagccagggaaggaacgaagaggggagccaggctccagtccagccgggaggaggggctcagatagacgactgccactgcacaaagcgcttggattcctgagggttgaaa

SEQ ID NO: 2523 - DNA, 1096 bp, Homo sapiens
  ref <308>: DATABASE ACCESSION NUMBER: Contig53130
  ref <309>: DATABASE ENTRY DATE: 2001-06-18
cccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctgtaagtcctccgaagacattatttttccaaaggaatttggtttcgtgcttgtgtaataaagccagaatttacttgttctttacccccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaacc

SEQ ID NO: 2524 - DNA, 917 bp, Homo sapiens
  ref <308>: DATABASE ACCESSION NUMBER: Contig53183
  ref <309>: DATABASE ENTRY DATE: 2001-06-18
gatctttttgctgattttattatactatatagatttgtatttcttgtgatctgagaaacatcaaaattctattttaaatttgttcttaaaaatatacaatattgcactttaatttttggcagcttaacaggaatgaatgagtacaaaaaatcatacaagaaactagaatttttattttgcttcataataagagctttgtgaaaaacaaaacttacagtagtgccaaataaaccaaatatttacagtatagatattaaagtcttacctctaaaggaagattcagtgtattggatgtaaatattattaatataagaaaagtcacccccactgcccaattctgctgaacattttaagccaaagagtattggtgagaaatgcttctgtgatttctttctcaagacatacatggaagggatgcttgttcttggagcatctaaagtgggtcattaaacttttacaaaaatgtttcctccataacttaaaaaaaacctctactctaagccaagaatccaaggtaagcttattttttattttttaaagttcttctgtagttactctctcttttttttaaaataaatagaaatgaggtgtcactacattgcctaggctggtcttgaactcataggctcaagtgatcctcctgccttggcctcccaaagtgctggaattttataggcatgagccaccgtgcccggccagttattctcctttacttttataagcatgtaagttagttggtaggttacaattttaaggtctgtttcctgtgctttttctaagatatattgaattggatactgaatacacatctgcctgattttcaacttttgttacattgtaataaaactgtatacatttactttgacccacaatttgtttttactttttttttctcttaactagggtctcgctgtggc

SEQ ID NO: 2525 - DNA, 991 bp, Homo sapiens
  ref <308>: DATABASE ACCESSION NUMBER: Contig53226
  ref <309>: DATABASE ENTRY DATE: 2001-06-18
aaaatattaccttttattttctcaggcacacaagtgatttggataccaattatcaagacattttactgatttccctttagaatgatctattttaaatcttcagccaccttagaaaaagtttgcagcaatcactttgcaattcataagtatcaggttagaatttagttgtggaataagttaacagtttatgttcaatatgtgaggttatttgaactcctgagttttaaatatcctgtggaacagtgattcctctcccttctaatggcttttcagattaaagcaatgactttaaaaagattacatcctaaatacttgattacaacagaaatcgaccaatctaaaaatcagatagtgttatactgaacatcattctgatataatgagtagcctctggctgaaacaaaattccaccaccaaggccatcaaccaggttagtactgtttttcctggggtctatgtaaaactctccttttctctgcaaatgctgcttggctgtgaacagcatggatttacctgcaccaatgtggcacacacctagcaactttctcaagcattctaaagatatccccagagctaacaaatattgacatatgtcacagcacctttctcaagaacagtccaaatcagcagtgcacattcacacacacaggaatgctggggatatgcttatacctgcaccacttagttacaacaaggggaaataagagtaactaatgaacttaatagcttcacaagaaaaatgttttatagtcatatacttgaccctatcagggaaaagccacctaaaagcatgtgtagctggttacaaagtgcatcaagggagagaatggctggctctgaataaacccacagtcacttctgaacataaagtacacattctaatgacagagatttggtaatattattttcacaaaccaaacagtacaaatttcaagttatttcacaaatcagatgatcaaataaaaatggacatgaatatgcttagtaaatt

SEQ ID NO: 2526 - DNA, 954 bp, Homo sapiens
  ref <308>: DATABASE ACCESSION NUMBER: Contig53242
  ref <309>: DATABASE ENTRY DATE: 2001-06-18
ttgtattctctaaaatttatttacagttaataagttaaaaagcaaagtacaagcagattataaatctcaaccataagcacatcaaactgtccagggaaacactttgattccattacaaacaattgttttctaatgcgcttaagacataacactctatcaaaaaatattttaaacacaccaataaatattaggcatgtatgtccattaaaaaccattaaagagtcctgtggcaatccttaaaacaatgaaaaacttttgagttcaaaattgctcagatattttgtattcaaatatttttaaaatttacttaagagttttctaaaaaatagtactatcatttgcacacagcagatcaataggtgtcagtcaccagcttaagttacacttgtcaatattcaaacttgaataaaataaacacacatcacaacagcgacactttgcactatcaacaatgaagcttgccctcaacaattatgacgttactggttttagtaacataaaaatacattgctggttgacaggaaggataaaaatgacatcaagaatctcaaaaagttatgtgaggtgccggtcaccacatttaggcactcaggaattaaaaatcaaataaaagcatagcaaggtgatgaatttcctcctggcttccccctctacttgtgccatatgagataaaagagaaggcaagagaatgaacgaagatcatgagatttctttcaaaaactatacacaagctaagctacagacttcacttcagaggagtaagtggatgcctcattataaaggccactatgccaagtttcttttcacattctgtgacaaagtacccatgaaatactttcactttcctattagtataccagtcaactatattagatgttgcttcacattttaaaagttgtcacataggtttttaccaaagggcaaaaataaagattttttacatcattatttcac

SEQ ID NO: 2527 - DNA, 908 bp, Homo sapiens
  Modified_base 1 ... 908: n = a,c,g, or t
  ref <308>: DATABASE ACCESSION NUMBER: Contig53248
  ref <309>: DATABASE ENTRY DATE: 2001-06-18
ttgattgtaaaaattttattctcaataacaattccactaaaattatacaaagtacattcaatacttaagaatggcaaaggtggggagaggaggagaggaagccagtttggcctggaagcatcaacagttgactccaacaaaggaagcccagctgggctggaggaagttgggggtggaggtccggttgtaaaaaataaaaaaggggatcggtaaaaaaaggccacccacaaggaagcagagtgagcgtgcatgttcctgggggagggcaggaggctcagctgacatgctgctgctgggcactggagctcaggcgggctccgagttggtggggggcaggtttttatgcttgaaatactgcacaacttgttggggcagctccgccagcacagctttggccaaggtctcttttgctgcgttgcggaactctcgaaagggaacgaactgcacaatatcgcgggctgcctcctcccccgtgtgggagcgcagcatgcggctgtccccatccaggaactccatggcagcgaagtccgcattgcccacgcccacgatgatgatggacatgggcagcttggaagcctgcaanccggcatgccgtgtctcctccatgtcactgatgaccccgtccgtgatgatgaggaggatgaaagtactgcgtggccgtccgctgttgtgtggcctgggccgcaaaccgggccacgtggttgacgatgggggagaaattggtaggaccgtagaagcggatgtggggcaggcaagctgagtacgcctgggcaataccatccacacctgagcagaaggggttggtggggttgaagttgatggcaaactcatgggagaccttccagtctgggggtaactgggccccgaatcccagagctggaaacatcttatcactgtcgtagtcctga

SEQ ID NO: 2528 - DNA, 718 bp, Homo sapiens
  ref <308>: DATABASE ACCESSION NUMBER: Contig53260
  ref <309>: DATABASE ENTRY DATE: 2001-06-18
aagggtacaaagaagtttattgactatgatgcagtaaagataccaagagttacaatatttgtgcatatggcccaacagtgcctaccctcctacaaaacaaaaacaaaaacaaaaaaaggcaatgaggtgcagcagttaacagcccaacactggagtcaaaggaatggagctgcctcttctggcagcaaagtttcaagttgtgcaattaaataatagtcttggtccactccttgtgggtcttcttacagtttccctttagaaccataactgagtgacttagtagaacattcatattcaggatgtggcctccagaagtgtcgttttgttttgttttgaacaaagacgtgctaccttctctcttgaagcaccagtgctgggttcaggagctacagaggactaagatgttccccaagtagcctgaagtaacaggtcacatggaaaacacaaagcaattggtgagtccacattttgtaatagaattaagagcgtaatgcataaaacttaaagtcatgtaaccacatgtaaaaacttcagcagctaaagaaaaattctggaaggcttttaaccccttctgaactaagttccctttctaaacgaggctggtttccatggctgtgacaagagctcatggggtagcaaaaagagagagagaatagcaccttagaagttactcaaacaagaggtgaaacaaataagtaaaaaaaaaaagaccacttta

SEQ ID NO: 2529 - DNA, 973 bp, Homo sapiens
  ref <308>: DATABASE ACCESSION NUMBER: Contig53268
  ref <309>: DATABASE ENTRY DATE: 2001-06-18
ccttcgtatgccacctttattgtgtttccccaactcctgggccccatggtagactggccacatggctactgggctcctggccttcctagggctagcagctggtgggcaaacactctgccctgctggagagctgccaggccatgcccgggcacaggctagtggggctcctggctcagtcctgatagcagtgccagggaggcgtagagtgcacacatgcggccctgggcctgcggctcccagcacacgtggggagtgtcctcccccagctctaggccacactcgtccagcaagacccaggccggtgctccttcgccccagctgttccccaggagcccggggggcagggacatggtgctgcgctcctgccacggggcactctgctccaagaggctgcccaccagctcgagcggccccaacagggtctgcgactccagcgcctccgccagcagcttgtgctgcgtttcactcagcatggtcagtgcccccagcaggtagacaacagggatagcgagttccggcaccagaattccggaggacaacaccaggcactccaggacagcacctgctggaccgtccaggggctccaccggcccaaggctctggcctgtccagcgcctcctccaaggctcgcagggccagctggtcccggagcacccctttcaggcccttccacagcagctggcacagctctctgtccaaaagctccagttccttggagatggtctccacctctgcccgtaggccctggaagtcttcagtgaacgccccctccgcagggaccccatctgtcaggaagttgtggaggcacctcatcatggagaggccagagggcagctgtggccaggcgccttcgctcgtggaacgcttgtggcctgtcgcgggtggctggaaggtcctctgcttcttatccgggaagagaaggacgtccaagtcagagtcaataaccagctgggccacccggaatgcgagggtg

SEQ ID NO: 2530 - DNA, 649 bp, Homo sapiens
  ref <308>: DATABASE ACCESSION NUMBER: Contig53281
  ref <309>: DATABASE ENTRY DATE: 2001-06-18
ggctggtacacactgctttatttgttctttttattattatttttaagttcacctacagctgcagtacacacacaccgctttatttggctagctgctattcagaagacacttcctgaattcaggaaaaatttttttaaaaacctgagaacaattcctgtgacttcttagctttgatgaagtgcatttactttgacattgatatagcttgtaactacttttggaatttttttcccctaacactttgatctcattaagggtattacaccttttccaccagaaaatgcagaggtatcatctttcttggaaaccaattgaaagcgtcccattttaacaaaatgacataaaattacaaacatttacatgattaaattcaaagcctgatccatctggtggtaagaaatgttaacttattttaaaagatgtatttgcattattaaaatatagtaacgacttccatctttacatcaaaagaaacgggcttgcataagcaatggctcccagctctggggagggtttgagccacgcccttgcgggggccgctccaagctctgacttcaaaagttggagtttcccagctgcgaacagctggtcaaaggcactctcaaaagttcaaggaaatgcccgtttgcggatggccgcagcaggcctg

SEQ ID NO: 2531 - DNA, 614 bp, Homo sapiens
  ref <308>: DATABASE ACCESSION NUMBER: Contig53296
  ref <309>: DATABASE ENTRY DATE: 2001-06-18
tttgttacagaggatctttatttataatgcaaaaaagaaattataaatcccattttggactgtttccgtatctgtaaaacaacttataaaaaacagccactccacctgcaagaagttcttgttggtgcttatggcaggggcatgtgtttgcacagccctgggggctgggagggtgtgtttgtccagaagagagcctctccctgggaccccaacagccaggaccatggcgctccctttcaccaggccggagtcagcaagaacctggaggtgtcagaggtccggtccactcagcggggcctgggaaacactgttctggaagtggacaggctggattcctcgctggtcctgccacgtctctctgagcggaggcccgggttcgctcagttcccatccagggtattcagcacacctgctccaggcagccacgcccccggacacctgaagccgggccgctggagcaggagccagccagccaaacccaggacacctcctcaggcttctgggtcgatttctccatcatctgggcacgaccctgtctcatccagccagactgtgctccccaagtccctcggcagcatcatgcccgtgggggtggggggcgtgatgatgatgtc

SEQ ID NO: 2532 - DNA, 438 bp, Homo sapiens
  ref <308>: DATABASE ACCESSION NUMBER: Contig53307
  ref <309>: DATABASE ENTRY DATE: 2001-06-18
gcattctgaagtcgtttttattcgataactaacaccataataaccagagttccatctgagaggagaggagagtgagaaggggccagaaccctttggtggctgagaagcctcctcaaggctatgttggggcagtagggaggcagagaggtgaagatcttagggaagcccctgacccagcctaggctgctgcccacagggcaggaggaaagcccaggaggggagacaagacctccctgttgcaaccaggaggctgagcaaggcactggtgtttacagcccacagcttcacccgggaggggcgagggctcctgccctgcgagagcctttaggtgtacagttggggaaagggcagttcagctgttggctggagccagttctccgggctccaggtggtgccagaggcctccatgaggtggaaagtgtaggcctggcgcgagcg

SEQ ID NO: 2533 - DNA, 519 bp, Homo sapiens
  ref <308>: DATABASE ACCESSION NUMBER: Contig53314
  ref <309>: DATABASE ENTRY DATE: 2001-06-18
gaatggaacgcatatctgcatagttttatttctttctcaattccaccagaaaaagggattttcagaaaaaggcacagttgtgcttcctctaaagatgtagtctgcggtttgggaagtgctggttccctgaggttatctggagcgctggttgtaaagaagaaagttcttgtcttggcagagcaggcagagtttcaggcttcggcagctgcctcccgcagctaagaatgcccaggtgcccatgagcaccaggattatcaatgctgacgccaggtttattccataataagaacttatgaaggtctgggctgacaccagcaggtgggtcaggagaacgataaggaggatgccccactttttcttctcacagccatcaaaaaatacaatgccccagaatacatgcagcaagataatgaccagcgtcatgaaagctgaataaaggaagaattgaggagaatctccatgaatgcccactgtgcctggccccaaggagtcagatagggtattcacaaaggaaaatac

SEQ ID NO: 2534 - DNA, 949 bp, Homo sapiens
  ref <308>: DATABASE ACCESSION NUMBER: Contig53401
  ref <309>: DATABASE ENTRY DATE: 2001-06-18
ccatacaaagaattttttattgacattgtaagaaacatttttttttctttgttacaaaaggactaagtggttctgaaagcaaaggtagagttcatctgtggctgggctgcagcccctgggcttgaggtgggcgtgatcacggggaatgcaggcttgtccgaggaacgcctgggccagtcacatctgaacgctatgcctacaatacttaaatgtatttacatgtgtttcttttaaaaaaaggattacacattttattttttaaaaaaatctaaaaaaggtgaaaaaaatgaacttgtattttattttacatgtctgcaggatacacaagggtaacttgtcagaagagaacatcctcctatcagttcaaaacaacacatgaaaccaggatacaagacagcctcgactctgctaccaccgtgcgctctctggctggtgcacacacagccttggagtgctgattgggcaacaccaactggtccctctcattgacaagattaacataaaataaggcacatacatcgcaagaatcaaaactttgtggctcaagaggaagagccaatgtgtgaggagttgggaggggttaactttttcagaaaaataaaacaaaaatggttagaaaacgtttaacacagacattaagcaggagtagaatgtgtgagcctgcatgttttagaaaaggcaggatggtgacactagtgaggcggtcctctcgctctaaaatgcataggttagagaaatggagagaggcttggaggctgggggtgagtctcaagatatgagatgcctagcctacaaaagatcccaaaaggatgtcccaaaaagatgcttctaagtgacctcaaaagaccttccttccactggactgccacaacagatcactgaaattctggaggagtatactttcttcttcctccctcctcacctctgtccttctgaaatttccatattg

SEQ ID NO: 2535 - DNA, 1012 bp, Homo sapiens
  ref <308>: DATABASE ACCESSION NUMBER: Contig53550
  ref <309>: DATABASE ENTRY DATE: 2001-06-18
tagcagtccataatgagcaacttttattggcattagggtgtcagtcctgtaaggatcatcacttaagtgtgtctcagtggagaaaagatcaagaatcatgtcaagaagaccatggggttttattccacttgagcaagagcaaatcagagccccatcaagcaggaatggtggcctttcccaggttccatccttaactaaactgactgttcccccttctgatttctccacggtcttctgtctcttgctctgccaaacttgttttcttatctctgtagagatgagtggcttgtttgatgttctttccatggcaaaaatttattcaatgcaaagttcacttcagacacttggttgagacttgaagtttagaccaatcctgagatgcgtggtgatcctgagagagagcagactgcctgccaggtaaatggtccatattatttccttggcagaggccctgacaggggctggggtccgtgttacctcagcagtctttctgcttggcctactcttgctgctctgtaggaaggccctatctggccatttctgtgaaacttgccccttctcaagcactccgtaactgttggtgttggcccatcaggcaataaggggatgcccgaggtctgtgcttccaaggataatagaaacacccatgtgtgtggtaagataaaggtaaggacactaaagaacagagtgtgagaggtgagttctaaataacaacagatgaagaaaggattggatccaccagcttctctgccagttgtgattttgatacaagttgtgttgctttgagctcctagcagagagctaacactacctgctgtgtattttggtcctctgtcctatactcctccaagacatttgcaaagcaccacttagatgggggactgggccatagtccatccctaagaaactgagagctcctgaatcccggatctctgtggcaagattcagggatgactgggtttccttacagaagaggagctcagctgagcaaagcctggaggacatattccat

SEQ ID NO: 2536 - DNA, 845 bp, Homo sapiens
  ref <308>: DATABASE ACCESSION NUMBER: Contig53551
  ref <309>: DATABASE ENTRY DATE: 2001-06-18
caaacataccaggatttttttatttttcagtgtaaaaatcaaacatgataaacctagaaaactatcagcagggctatttcttacagggttccagcaagggttagcattgttacatttcagaagctgactttctttaaaccatctttacagaggagtaaacttcacagttccacacatggctgggctccaggtagaactccataggagtgacgagggaaagtcaccactgggcagggagggcatttctgagaaatgcagatgagaggagaggctgtgagcacaggctgtgtcaaaacccagggcaagggctccctcccgccttccctcccagtgggaaggccaccctgagccccaaaccacattctgttccttcctcgtcattctgcagacaatggtcatccacagaccacacgtgtggtggctttggcaaccagaaatttaaaataagctatggtttttccagtagccaaaatgatcctgcaccaaagctcatagactgagaacctgagcatgcaaaaccacagtctgggtgaagggatgtctgctttgtaaatgacctgctaattctttgcaacccacagtaatttggtttctgtgaacccacagaagcaggcccaccaaaaagggccttgtctgctagcctggagtatacatgagtcactggcggtgggatcagtcattttttaggctgccccattttcctaacatgttaaaatgtgtgttctcagtcttttcaagagaggaagaagcaaagcggcacttacagagtgtgagatagacacagatctgtggcgagggattggggaaggtgggtggcatcttgggactctctccaggctttctgg

SEQ ID NO: 2537 - DNA, 1282 bp, Homo sapiens
  ref <308>: DATABASE ACCESSION NUMBER: Contig53598
  ref <309>: DATABASE ENTRY DATE: 2001-06-18
caacatctaaatagacttttatttttattttacttgtttggacagaaaagaaaattcatcagctttcattagagtctccttaagtgttggaaacacattaaactcagaaatagtggaccttgtagaaaagcatcacaaattaaaaatatatttctccatgtggtaaaagtgctttcaatcccattaaagggcacagcaagggtgtttggaaacacgatctgaaatttggcctgcaatccgtggcatcgattccaaccacagggcgggggagtcaccatgatctagagcacaggagccacgtggggcccggagcatgcggacagcaacactcgcaataactgagtgaggacgaggcccatagcctgagtagaatagattctgtatttgtaaaaaatgaggtggttacatcaactgggttgaagggggactgggtaatcccagaaattccttgtttctggtctgtggggatggtcagatctgcccaccactctggcaccgaggcttccctggagacgcataaacctgggttgggaaagtgcccagatctgcctgggggacacacgagcctcgctgccagtgccgggcacgcagcctctccagtcctgccgtcagcaaccgcctccggccctcatgtcaaatcacacctgaccagagttgtcaccacagtcctgttttggggtttttccaaggccagccctgttgttctgaggggccactctgagcaggcaaacactgccagggtcactcactacacacagaggaaagacaatgagcaaatggccatcgtagagaattcggttgtgtgtttcagcaatgctacttatttttcaagacaagtaattctgccaatgatgacatctgcgacaaagcttagggcccgcgggctccccatgcgcctcgtggagagcaaccacgtctgttcggaagccagcggcccttcccggccctgccacaggccagaacacagaactgtgatcatgcaaagagccgtgactgaggccggggtcagcgtcgggggtggagaggaggggacatctgccttttacattagatctgaagcaacagtaagaaaataacctgaagatatatttaaaaataaaaaatagcatcatccttcactccaagtttttggcatttccctctctcccctgcccaccagctaagcagagggaatgagcaggaatgcctcgtttttcagaatgggcacccactccccatttcaccactgtacacccaggatgtgtgtcttcttctaagagaccggttcaaaggtgctggcatg

SEQ ID NO: 2538 - DNA, 928 bp, Homo sapiens
  ref <308>: DATABASE ACCESSION NUMBER: Contig53646
  ref <309>: DATABASE ENTRY DATE: 2001-06-18
gtggaaatactttgcagagtttatttggacaggttcaaaaatagtccttcgacaatacaatcagatcgaaccacgacaagtaaaatgcaattatgggttggttacatttttaaaaaatgtaaacaggtttgggaaaactaaaagcaaaactacatcgtcatctcctccattcccaacccctgcatttcttacaagcaggacttcaagacggcatctgcaatcttttgaaatggatgagaggatgacactcactaaaggagacagctcaacagtgtgttctgaggccatttctcagaacaaaggcatacttctgcataaggcaaatgcagcctgataaagcttcccctagtgggtacatggaatgccaaagtcattcacctaaatgagctcaaaatacatattgttctgggccaaattatacagtgtcaagctcagactgtatgtatttatgtatgttggcagagcaggccacttttggggcgccacagctttatcctagcatcctgtgccctgctgggttcccatcgctgtctccccaaacccatgaatttccttggatttggttccagaaaggcagacaagaaacaaagtcagttgcacaagcccacaagggaacagggccccagaggacttgaatttctaatgaaacttaagagtaacacagaatgtgtgcctttgccaacaagccgggactttctgaaggttgatctgagatgggggcagggagtggggacaagatcaagtgtgctttgggccagcctccgctaagggcaacaaggcgggaatacaaagctatctagaactaaagcaactggccagtgcttcctgtggcctctatccagaactattccctcagacagctgacccctttctcagagcacttcagtggtgcttccaaggtgccaaagggatccatccaaataaatgc

SEQ ID NO: 2539 - DNA, 819 bp, Homo sapiens
  ref <308>: DATABASE ACCESSION NUMBER: Contig53658
  ref <309>: DATABASE ENTRY DATE: 2001-06-18
acaatttcaacatgttttttatttgctcacttaacattccaaacaaaatgacattttacactattgcttttacttaagaagtcaactgccttatccaaagtagacaaaaatcccaattcctttaagtgtccaagtggtactttttcccccagagaaagctacttgaatactttaacagaaacatagaatcgtcctataatagtaaggtagtagttgggtctaacctgtactacatttaaaacttttctcattaaaaaatgaatacagaaaaaaaccccaaacacctccagtcatcattcctctcagatttttaacaattccactaaccttcattaaaaattgcttttgtagagaggtgtataaatatgaaaatggaaagtaagcctccccacacctgttcatagagaagtggggtagagcatttatcctgagaaaactgctgctggtccctgttatttcaaaaaggataataaacattatggcccaccaagtcaaacctcctatcttctgtgccatgatcatgtgtaaccttttctgttctggctacgagcatctacttttcacactcatgcgattcttctcctttgagcaaatctttgatgaagttgtatttcactgaatgttctcaaaggggagaaagagtgcatgagcaattatagtactggaacaaaagtgaagagtacatatattttcacgtagaaaaaatacatacaaatccaagtagctcctaaaaatagaaatcagatgggcatttttaagaaaaagattgttttctaaactgtaaatggtgccagtaagacactgatttttatatctagc

SEQ ID NO: 2540 - DNA, 1343 bp, Homo sapiens
  ref <308>: DATABASE ACCESSION NUMBER: Contig53698
  ref <309>: DATABASE ENTRY DATE: 2001-06-18
gatgtaaagcttataatagcaggtcaataaatatctggtgaatgagtgagtcaatgagtgaattatgtgagtagggtaggaagacaaatgagagaagcagagtcaggtttcaagcagattggggtcagacaagcaaccttgtatttctcagtcttggcttaccagtgctgctgactttgccgtgagcattttactcctcattctcccatcctggtcccctcagtatcctccctaaaaggtggaacagcactgagctgacctttccccccaaaccccaggcctcacttctgcctccgaagccctctgctgccccagtaagggacagtagggctgcacgctgcctctcagctgcctgcacaggtgtggccagagagcaggactggagggttccttctggtaccttcttgaagggctcccaatgccaagctcctttccttcccaccttcacatcactgaggatgagaagaggtgtggaatgagtggggatcagctggggcagcggggccccgagtggctgtgtcctgggtgacaccagagcactggaaccatggcactgtccaaggaaacccgaaagaggccctgcagccttgtccctactccaaggtcttctcagagtggcctggggtcctcgtcagagccaggtcagtgagcctgaacttggcttggagactttctgaaaggatggagagtgctggttcctccaagtgaggggaacacaggctggaagcctccctgccctggccctgccccctctagtttttggtttgatatcagcccttctgcacagggagcggggaaggagggaagaagagagggaggggacccaaggctcaggattccccgacccagagcccctttaaggcagataatttgtgctttacaaagacattgatgaaaacacaaacaaaccctcaatgaccaaacaaatgagagagagagagatcacagtgtgtcaagaagggcagcaagatcgggagggaggtatggggtgggaaggctggggagtccaggcggggtcctcagggcaggctagcaatgtctctctctggaggggggccaactggcttggggctgctctcgttggcttttccttcaaacatcatgactaacttgaggacagccgaccgtttccccagcatcatgttcacaaagtctcggtaggatatagtgtcactgacccctcctgtcacctctgagatcatcttcttcatctccaggtgggtcttggggacaccaagcttctccatcatcctctttaaagacatcaggtcaatctcgccttcattgttcaggtcaaactccatgtacttctctttgaaggctgtgagcttttctggaaggtt

SEQ ID NO: 2541 - DNA, 702 bp, Homo sapiens
  ref <308>: DATABASE ACCESSION NUMBER: Contig53719
  ref <309>: DATABASE ENTRY DATE: 2001-06-18
aacagtggagtaattttattcacatagggttgcgattaaaaggttaactcattcaaacacatttttgctatgctaacattcctttgcctcttattcttacaaataaacccccatcacagagcagaaatgttagaaattatatcacaaatggagcacaataagtatttttaaaaccttttaaaatatggcttataattttacacagcaagttacctattaatatgttacatattaacagatctatttggacaatcagatttccttgagattaaggatggagttggcatttttcctttaagaaggcattttaaggccgggcatggtggctcatgcctgtaatcccaatactgggaggccgaggcaggcagatcacaaggtcaggagttcgagaccagcctgaccaacatggtgaatccccatatctactaaaaatacaaaaaattagccaggcatagtggtgcctgcctgtaatcccagctacttgggaggctgaggcaggagaatcgcttgaacctgggagatggaggttgcagagccgagatcatgccactgcagtccagcctgggtgacaaagcaagactccgttctcaaaaaaaaaaaaaaaaaaaaagaaggtattttaagcctgttaggggaggttctatagtatggagcttctttataaagtggtatcttatgtatatcaaaaacaaaagcgagatc

SEQ ID NO: 2542 - DNA, 1616 bp, Homo sapiens
  ref <308>: DATABASE ACCESSION NUMBER: Contig53742
  ref <309>: DATABASE ENTRY DATE: 2001-06-18
gttcaaaaattttttattaataattcattttcatagctcagaaaaggatataatcagtagaacaactaaaaacaaaacctcacctctacagagatagccagtgtgtagactttattacataggcacatattaaaaaaaaaaaaacataaactggttttacataaaattaaccacaatagtgcaagaggttacactgaatgagaatggatgatgaatgatggaaaatgtaaggcttggaacagctgaatcattcactggatcttgggttcatccatcctgacgcactgaaatttattacagacattacaagaatggagggtgaggaatggtgcttctctgtcatcgcctggctaaaacactgattttgattaatctcttgaatacggtagttttctccaggttctcttgttaagtagacataaaagttaaatgaatgctggcttaaggtcagaggagttcatatccttctcttccctcacccctatactttagaactctcacacccaacaatttgctgttgggacctgactatacatctgctttcccacaatgctctggtagaataccactggggttgctgatccaaagcacatggaggcgcaacagtgcttaaggcttcagtcatggtgtggggctagacagcatccccaactagaattgagggtttgatctgtggggtaacacgagcaagcaggaagaggatgctggaattccttactctgtccagttggaatcaatccaacacatctgactaccacaaatacaaccagaaaagaaactaaaattacacactcaaacataccatgaaagagatgctattttgtagcttgtacatagtttaaaatttttttaactacaatttgatgttactaagagacaacgaggatacagaggggactgtcccttttctctcatctggttttgccataacttacaaatagtcccaggatgtttactgagtgtcctccttcaattttcacaatattttatacaaaatgacaaatatatatatacctcattgattatcctatcatccccagtacttggagggttagacctacttctgtgtcaggtagcacccaaatcctaacatctattttggagacctgtctgtgcctcttcatgctcacaccattgttctgatagatgatgccagtggaacttccaaagaagcattccacctgatcttcaccaccctggttgatcctctttttaaaggtgtgtgtggaaggcaactgcaatatagaggatttggaaggttgtctgtttctgttgtctggggaaatgataaaaaaaaaaaaaaaaagagagagagatgtgaaaaggaaaaagatggaccaggtgatttttccaatcttcaaaatttaaatttcttggttcttataaacataggaagagtcactgaaaggtggcaccaatggatattttgtaaaataacccacaactttagagctggaaaggacttgaagaaacaattaatccaacttcctcacttttttgtctcaggaaactgaagcccaattgggaaaacagcaacttacttaacatagtgattgtctccatggctatgtcctgtaaagattcacagaaaccccaatttccccttaatcctcgtg

SEQ ID NO: 2543 - DNA, 1118 bp, Homo sapiens
  ref <308>: DATABASE ACCESSION NUMBER: Contig53757
  ref <309>: DATABASE ENTRY DATE: 2001-06-18
ataaacataactgcatctttaattgggtgtacttgaataattgaaaactgaacagcaaatcaatttttatggttcattttctccaacaaacaacaatattaaactgtatgagaagtaatatttattgcaacaggttatgaggtggaaacaaataattagtcttacaatttgctagaagcatgacagagcttactaacattttgaagaaaaaacagcaaagaaagaaatcatcaaacaagatggtatcttgacaaaggcacagcgctccacaactgcttcatactctgtgcacaagaaatcctctcaagagagaggagaggagtgatgccaaatgggcttacattagacccgtggacactaccactggtattattcatacaaccaaggctctacaacacccctctggagaaaaagtgcaacacaaaatctgtgtaacaaaggaaagcaaaagtagcaataagggcccagaggaatacaaacagtgcaaatacagtactgcaaactcagtaaaaggagtttttgattggagtatgaactttcaagttgaagatatatttcacaggaatattcacccaaagcttgagagctagagcgaggagagacttgcagtcggtaactgagtagatgaaatgcataatttttcactaggtgataatttcctttgggaagaagtgctttatctttaattattccactttttgttaaatggttcatgcttttaaactgcgattgtctcaaacttgcttgctattgaattgtgtaacatcagataatggcaagttgtcaaaagataaccccagtggatatttgaagctgcttttacgagaagcatggtgctgagctgccttacacagtctttttacagtaaccataaaaaactgagtttatttgatcatgtattatcccttctcacataaagtcatattagaggaattctttttaaaagcttctttcaaactagtcctttgggcatttaaaaaatcattatataaaagtacacttcttcaatacataagaacaaatattttttctttaccaaaaaaacctcatttttaggccaaaataagttacaacttgctgaaaaccttttatggctcagtgctcattctagatatatg

SEQ ID NO: 2544 - DNA, 517 bp, Homo sapiens
  ref <308>: DATABASE ACCESSION NUMBER: Contig53870
  ref <309>: DATABASE ENTRY DATE: 2001-06-18
gagtgccagacaatctttttattgttcactgaaaaatgcaggtctgcaaagagtcaattgcattgtatattgaatgcaaggtctgatattgcaagtatatatgacatggtataacatataaaatattacatattttacacagtgacagtacccgcctcttctaaacactaaaatttaatagaatgaagtaaaaagcctattaaataagaaacaaacactgcaatcataaacaaaatgcactaagcaaaatactttaaaattgttgtgtgtgacatctatcttgtctacctggagttaggaatggtggagcccagaaaaaaactgagctaacaaaaacagccaacaccctccaggaactcttccctggaatcaggccgctggtgcccgtcacaggctgcccccatctgatgacccagccaggcttcagggctgcctgagggcccacactgaatgctaacgcctgtctggggctgggctgaggtgaatgggaggagtaccaggtaggaagaagcttctc

SEQ ID NO: 2545 - DNA, 893 bp, Homo sapiens
  ref <308>: DATABASE ACCESSION NUMBER: Contig53944
  ref <309>: DATABASE ENTRY DATE: 2001-06-18
gagttttagcaggaggggatatgcatgtacacatatgcatatacatacaggtttatttaagtgattggatctacacttttggaggctatttgaagtatcttatcaaaataaaacgcattttaagcaagaggttaaaaaagcttttcagacccgaaggccatttaatacagtaaatcttacttgggtagtttagcaaacattttttaaaatccacatccaacagattggttagtattagatacacagatttggtttcaaagctgaaatacccctggtggaataaatcttctcatgaaattcagttatattatgccacaaaacagggacacttatctattgacaacttaaatattaactcagtaggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctcttgcgggtcaact

SEQ ID NO: 2546 - DNA, 869 bp, Homo sapiens
  ref <308>: DATABASE ACCESSION NUMBER: Contig53952
  ref <309>: DATABASE ENTRY DATE: 2001-06-18
ctcatcagcaatttcaattttatgttttctacttatttttatataagaatacaatgcaacaaaatattcatatattgcacaaacagtgatgtgcatacaaagatgctaacaacattggctggtaataggctttaccatgttacgatctaaatgcttgttcatcagagaatgtacaaaattctaagtttggcatccaaaagggggcttacagttattgaatatttttcccagccctattttaaatcaaattcaagtttgcctatgacaaagactgtctataagtaacagggcaagcataccaacatcaaaattattcttcttcttatctcatgtgcccctatttctcccaaataagtgacaaggagagtaaaaggatcactgagggaacatttgaagaatgctactaagtgccaggtcctgtacaaggtaattaattactacaaacactctcgtgatggacatggccaatagtgtattttgtcaaaaaacaaaaacaaaacccaagattccagaagctgtttctgacaagaagtccttgtttcagtactcttcagtatgagtccttacttgcaggactgaggaatgaaattgagaaagaacctttaatcattagaaaaggacccaataaaactatacttaaatggatcattaatgtggatttttttacattcgtgtgggatagagaataatcccatgggaaacaaacacattttgaatattttttaaagaagtagttctgattctaattttactgtatgtttaggcatcattaaggacctctgatttgaaggtagatttatgtgccagggactccaaattcatgacatgttttaaggctccatattccatgcaaaaatggacttactgag

SEQ ID NO: 2547 - DNA, 1000 bp, Homo sapiens
  ref <308>: DATABASE ACCESSION NUMBER: Contig53962
  ref <309>: DATABASE ENTRY DATE: 2001-06-18
aagcagtcaggagatttgagatttttattgagaaaatagctattttgacattatatccagtttctcatttatcagaataaattctttacaatattgatcaccatcaccactttagtgtatttgtacatagtctctgagtaaaatatattcacactcggcaaggctagaatattgaaattatggccaacattgcttactttaagattgtttactttataaagaagctagagtagttgtgcaactagaacagatgtttttaaaatgtttgccattcaaagataggcttggtgggacaaaactaatatgcatactacatacatatatttcttgtcttctttactgtcaatctttcagaacagtaacatgacattacaaacacctcaaattcccacttcaaaatgaacagaaaaatggaaaaacattatttcccatttcataaaattaaaaatcaagtcagaagagaagtaaaactcatttttatgcatttaacttaaaagcttgaatacacgactcctcctagagagaaggaagccagaacttcagaagtagccagtggtccaaagaataaatggccccatgaccttctctatggttcatgacttactgagggctgatgcaaactctggcaagttatttttcatgatttccaaggatctgggatatgtaaacgaaatgattaaaagacatttctctgaatttgcaagaagacgactgaagaatcagaacaaagatccaacggcctttcacgtggctacatgttcaccattacaccacaactctaaacccacaggcgagctttctctcaaatacacattcaaaatggtgttccaaataatccaattgtatacattgcaaagacacacaaaatgcctccttacacacgattagtaatctggttttagactctgaagtgataccaaacatatttagctaaccctctcaaaattgcaggcctagtgaggtttaaatgttttaggatatagaatctgcttagaattta

SEQ ID NO: 2548 - DNA, 518 bp, Homo sapiens
  ref <308>: DATABASE ACCESSION NUMBER: Contig53968
  ref <309>: DATABASE ENTRY DATE: 2001-06-18
acagtgcaagggttttaatagtccacactaaaataggctgtacagttttgtagtttaacattaaaagcaatcctgccttattttaaaatgcttctacttaagaatgcttcttcctcccccactccttcacttaaggtataagtctacccctaaagtgcatttctcaggcattaaaaacagcactgtgatttgctttccacagagtcctaaataacagccaccttcttcatttgagaggctacagagttcaagctgagctgtgacaggagccagggggccagggccccagaatagctttttgaaaaaaaataattatgccaccctcctccgcggcaggtatcttctcttaccacaaataaatatttaatgcatccttggagtcatgaaatattgagaacccaattgacacttcaatttccagaaaaataaaatcatgaaggcattgtgtaaatattctgaatttggtggaatgagacaacgcgtaagggggcgggcctgaagtctcgggtttggaactg

SEQ ID NO: 2549 - DNA, 1328 bp, Homo sapiens
  ref <308>: DATABASE ACCESSION NUMBER: Contig54113
  ref <309>: DATABASE ENTRY DATE: 2001-06-18
ggagttttaaaaaaatttattggctatgtttgattatccacaacagaatttcccttaattagcacaggaaattgaaagttggttataatttaatatctctgctcgtcttcaacagacatactcagcatttatacttgtaaatagaattgagttttcattgtttcgttttctgtttttgtttccttaggaacaagaggatgaaggaaatatggtcagcattttaataacaccataaatccaagataataagtaattctataaagttttccagtttcattaattcagaatttcatcatataacttgaaatccaattggcttcctctttcttagaaacaaaaaccaaagaaacctttttctgaaagacattattttccagtattaggccaatttgtcctcaaattaagtagaatctcaacatcttgttgagccagtttgtaaattccaacttcatttaatgctgctgtggcaggaagctgccctgaagctgactgcagtacatctttcagcagtagtgcagaaccgacgttcaaattcaaaacaatacaggcttcttttatatgtttaaaataattttctggtctcttgcaatagtgagaaaacaaagggaaaagattccgagtcatatcaaactcgagctgggctgctcctccttcattgaagtgattagcaagaattatttcttggtagatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctttcttttttatacaattttgcagcatctttaacttctctaaaaacgtggtctacttgacgggtcaacatatcatgctttaaacgttctaagaggttaatcatgtcatcaaagacagagctctccatagaggctagctgtcctagctgcaatttactcagagtattattctctgcaaacacctccagtgcagcctgttgaagttgtagaaagaaaacattgtcagcccaatctgctagtactgttgagatgtagttcacagcattaagaattgcacagtatcgaaagccaagggaagctctagtctcttctttcatcacttgtgttaatcgtatcctaaaatcatctactaagtccttctgtaactccaggaactgaagctttcgggaagctgtgggaagatttttatacctgtcagttataaccaagagtagagtcataaaagtttctgcacaatctggaactttca

SEQ ID NO: 2550 - DNA, 738 bp, Homo sapiens
  ref <308>: DATABASE ACCESSION NUMBER: Contig54142
  ref <309>: DATABASE ENTRY DATE: 2001-06-18
ggtttggcatagtttattacaattagtgtgcgcataaaaccatgtaaactctacaaagtaaaccacttcccctccacactaaccagcagctagtctgccatgaccttccagcacccccattattttaacatatatacatttcacaggatgtaataaccacacaaatagggttataatacattcttcagggaaaaaaatttttggtccatattttctattaaaaaaacacacacacttccctctttggcaaaagaggttaaatctcccatagttaactcacaaaagaaactcaaataaaaactactgagcatgaggtacagctgatgtctggactgttctggaattacagacgcctccttgaggggaaaatcatttcttataaaatgagatcagtttccaacagtttcatgtcagtagaaaagctcgatttagacttggtcagaatcacttttgcatgaacatgttccaaataactttgtttttcagaggacagcggaagtcacgaaaatgtgctacttctgaagaaagtcatgaaaattgtggcgtctgacctcagcaatatttttaatctgaggtacgaaaacatctgacacagccattcacactgtaattcctgtgccaccttcatggtcaccggagctgggccgacctcttcgcatccccctctgaagtggagactaaggaaacgggcagctgctgaggtgttgtttctttgcttgtttttaaatctacagtcat

SEQ ID NO: 2551 - DNA, 469 bp, Homo sapiens
  ref <308>: DATABASE ACCESSION NUMBER: Contig54232
  ref <309>: DATABASE ENTRY DATE: 2001-06-18
tttagtctttttgttttattcaaatgtcaaaatgtaagttccaagatacaaattatgtttgatttaaaaacatcgactatgctttgttaacaacttccaaagccaaatgtaagttgttgtgactaaaatgcctccccagtacatttctggaggattaaccttaatatgtttagcagctagtctgatttccactctacaaaaaggaaaatgatgctataagggaaagataatgaacaaagttataatatgtaagacttcctgggaagaacttgaaccattactagggagaccaaggagaggtgtttctgttccatactatagcaaccagccttaacactctgtaatacaaagtgcatttctggtcctacccagccataaataccatacatcccttttattaattatatcaaagaaagcccaactcttcatcaacaagatttagaatttcctaatagctttagtttttccc

SEQ ID NO: 2552 - DNA, 751 bp, Homo sapiens
  ref <308>: DATABASE ACCESSION NUMBER: Contig54242
  ref <309>: DATABASE ENTRY DATE: 2001-06-18
ccacaacatcccctttttattgatattaatcacagttatgaggtcttgtccatcagaaagcacaatttgcattatgtagaactacatacaaagacataaaaataaaacatacatacaccaaccaccacaccagttaatctcaaccaatcaaacctctgaatgtgtcttcaattttgatcatcagtgcttcggaagaacgtacatagacccagcccaaggttggcctttggggtctgatagcattcacagagcaggagattcacccttggaagcaattgaatgtgtaaactctgagagcagacactgacaatgcaatgcctgcatacctgactcctgggctgccttccttctcagcagagcccactgaaagtctcacgtgtgcctttaaccaatgaggatggcaggccttatctgtgtttgaagtggacaggtcattgctacccctgttggagaagctatgtaagaaggagtaggctggcttctggtctagttcgactcattctttatagggacatttcagaatgatgagttggctaaaatttactttaaaggggaaatgtaaaattacctcttcttttcctatccccttcttcctttcccatcctgagccctctggcaaggcctgttgcagctcaagagtttttggtcagattacaagttaccaaatggtcaacagggaaggacccactgcagattccaaaagtctttcattcacttgagttaactgaaatggctccttctttgagtaatt

SEQ ID NO: 2553 - DNA, 492 bp, Homo sapiens
  ref <308>: DATABASE ACCESSION NUMBER: Contig54260
  ref <309>: DATABASE ENTRY DATE: 2001-06-18
ccaatgccaaaaactggtgatttatagaaatcaccctggtttatttttttcaacaaaggaaaaaaaaacatggttcaataattcagcatttgggactctggcaagtactgtctgcattgttcaaaataagtgttcctggctgtgagctctgcaacacatactgatggcccaggaaccttcttccatggttctaataaaacaaaggacccacacatggaggttacgtgagtcaacaaaagatgctctatcacaatgtgcgtaaaaagcaagtctttgaaaaatatccagatctctaaaggaatacaaacactcctatttggttttgtttttgttcatcttcagtattatattttagttgttgaggaaaattttttttactgtaaggaaggagttatatgactttataagtgggaaccaacaggctgccggctaatacatacgctttccctccaagtcaagtagctttttccccccgaaagcctctttcatgat

SEQ ID NO: 2554 - DNA, 979 bp, Homo sapiens
  ref <308>: DATABASE ACCESSION NUMBER: Contig54263
  ref <309>: DATABASE ENTRY DATE: 2001-06-18
tctctgtaattctttattaaaaatactgctgtacacatagagactgaaaacaggattaaagatgaataacacaaattgggtcatgacattagaacctaacacactggtgctttttagggaagttgttgacatccaaatcacagaaccaaggtcaaaagcaaaatacaaaggtaccctcaaaaatatttacaatgaagtaaatacactaacagaatttaaaacaggtacaaaatattgaaatgaccaacgttacatgatttcaagggttgtcctttctgtgcttttatctgtcacgacaggaaggtgtggaaagtttatatccttaatttgactactcttggatattaaaatctttctattaattaaaaagacttttagacaacctcttaaatggaattacactatggaaaacagggctcccccaaaaacacctaggcagaactgagagttctttgaaaaccattcccaataaaaactaaatgaaaaataaatataaaacaaagcttaaaaaaatatgcattacctgacaccaaccttttctggctgacaatatttattcatgaaaacatatcagctgtctaccttttatatgcaaaccaagtcctgaggttaactaggggctgaagcaaactagcatttaggatgcaaacattcttggatttgtgatgtaaacttgccttgcacagggaagtttgctggtctatacagaatgagaaattcaagccctattttaacccctgccctctttagctttcacaaaacattggtccacaaattaaattttcaaaaagttcccagaccccaaaactaaaatagatgatcccctttcattttcaaagaaaacaatattggaaaaaatctccagcccgcttataaattaagcatttcatatttcttctagaatacaagtagttcttttttgtacaaaagaatacaatatgatttgtcaaaaaacatataaaaagacagctgctcttcc

SEQ ID NO: 2555 - DNA, 939 bp, Homo sapiens
  ref <308>: DATABASE ACCESSION NUMBER: Contig54295
  ref <309>: DATABASE ENTRY DATE: 2001-06-18
gttactaacgttttctatttattcattaataaaaagtgcatagtacaagccctttatcccaatccaagtactcagaaaaagattaacaacagaccctggatggcacagacataatttgtttggcgtgatttaaacatataaaatcagtaattaacatttagcatatcacacgaccacttttgcttttaacaaagtaatcttcacacatggtaacaaatacctatgatttttcatttagaaatattataagaagactaaacttactattgcaacaacaaaaatttaacccattaaactagaaactctcttcatttttccttcttcaaattactgttttgtgtcttaaactgagttggtcaaatttgagcacataattcatgtagagtgacagactttcatttagagtgatagacttccaaggttcctttgaaaatttaagatactggtaattccataaacactcccacaccacataccacaaaaacactaaaagtagccatagaatagctgtattcaataattattttggaaaatccacattatgaaatatgacttgctgaccatggaacagtgcttggatagataacatgaaaaaaatgaaaaacatcttttttttttttttttgagacggagtttcactcttgttgcccaggctggagtgcaatggcgtgatcttggctcactgcaacctccacctcccaggttcaagtgattctcctgcctcagcttcccaagtagctgggattacaggcatgtgccaccacaccaggctacttttgtatttttagtggagatggagtttttccatgttggccaggctggtctcgaactcctgacctcaggtgatccagctccctcggtctcccaaagtgttgggattacaggcatgagccaccgtgcccagcctgaaaaaaatcttttactagaaacagttccaat

SEQ ID NO: 2556 - DNA, 522 bp, Homo sapiens
  ref <308>: DATABASE ACCESSION NUMBER: Contig54318
  ref <309>: DATABASE ENTRY DATE: 2001-06-18
tattaccacatccaacttctttattcttgagaaaacaaaaaagtccaaaatcaaaggaaagcacccgttttaaaccctcatatctttctcagggctcactgcagtctggccatatctcaagcaggtctgtccaatggcttggaacatagacttttgcagtgaaactttaaaaacattacttgaattaggattacacaaaaaaaactaaattctaagtgagcacaactatcgctgagaccctgaaatttcaggaaataaacatggttcaaaactcaaactgttcatcaaaataattacgcaggtcagccaccactgcagaaccatcactgctcagaggaattgagtcagcaatgactgatctcatcatctcttcattagcacataagcggttcaacttgggatacgcaaggagtctctgcagaggtacgaaaaatttatctccaacacagaagggtgtgggagagttctctatcttggccttctcaacctctgtgaagactggtccaaagcatgggacagggg

SEQ ID NO: 2557 - DNA, 686 bp, Homo sapiens
  ref <308>: DATABASE ACCESSION NUMBER: Contig54325
  ref <309>: DATABASE ENTRY DATE: 2001-06-18
aagtttagggcatttatatatctgcaacccaataaacccctggtaccatgcagctcccccaaattcagtgcaaccaaagctgctgaaacaagtccagccccagaaggtgtagtggcactgtggtgttaccttatttttatatgacccttcaaaaaggacactgaaaacccagtgcctgtttgcagagatcatgtgtggaaattgaaaccctgtctttaaggaatgaccaaattcatgctacttaacctgaaaacttgggggcaaagtggttgtgattatctgaagggctgctatgtagatgaagtattaaacatgtcgtaggcaaggtttagaggagaatgtggtacttaaccttctatagatcccacaatgaaatgacctgccttgtgaggtagtgagctccctgtcaagagagattttcaagcaatgggtagaagaccacttggcaggagtgttgcaaaaagtgggctaaaccagatttttccaacctagtatggaggaagaggcagagtaggggaaggtcctgcccctatgagattctcctgattgcatgcaagatgacaggtaatccctgtgtggacagactagaaaagcagacagcccctaaaatagatggggagaacttttagccctgatatccacacaaactattttaggatagggtagcttggaaaactttaagcaaa

SEQ ID NO: 2558 - DNA, 1023 bp, Homo sapiens
  ref <308>: DATABASE ACCESSION NUMBER: Contig54389
  ref <309>: DATABASE ENTRY DATE: 2001-06-18
gtggttttaatctgtgttttgagatttttttcaaatggaaagatattacagatagaaacacatcattctaggtttcaaaatcaccaaagtcagtgagaagaatgtacattcatttaaatgtaatcatttgtaaataaagaaatcttgaaaaggctgaacagttcaatcaaattgaagaattgatctagatttttcattattctttttaaataatgagtaagtgtagatatagtgtacatacaagttgacattctgattcattcaaaatagtcacatccctttgcttggttttggatgttccagagactaaaatttaataccattcataacatagtattttcagtaaaaagaattatagagcaatgaaaaatcagaagatggctcagagagccttataatctctaaatatacacacatttataacctgcatttattttctaaagaaacaaattttaagtaatgctaatttaaccaatggagaaaaaacttctatcaaaatatacaatttccattacagactagaaggctaatattaaaaaaatagttgtaagccaaaaagtttgcttatatggatgacaggtatcatctccttgaagcacaaagcatcaaataaggtcttataaaagatcaatctgtgaccttcttcatttttaagttcttgataaattcataaagcttgagtctcaatttccagaaatggaggagccaaataattcagaatctcaagtgcgatttatgctttaccatgtacctgtccaatgtttcccaaaaccgtaagaacactggtctatccaaatgacgtttgtgatagctgagttctaatactgttacatcccatttctgaacatttggatccagacgaacttcatcatacttcagatggaaggctttaacagtcttgaggcataagtttaaggggctggtctactactctataaggtactgtaacactaattgcagtgccccctggttgcatctggtcttttcttctttgtattagagtttcattttctcgttgacaac

SEQ ID NO: 2559 - DNA, 580 bp, Homo sapiens
  ref <308>: DATABASE ACCESSION NUMBER: Contig54394
  ref <309>: DATABASE ENTRY DATE: 2001-06-18
cgtaaaagaactaatatttgcaaagaaaggggacgaggacattttctaataagcattagccaggagcagccacccccaagtacattttattcccaggtatatttattttgggactaatagcaatcaaaacagagtaagcggaaggtcttttttgtaagggtaagatgactgtgttcctgcagcctggacactgactgctgcaatgaaattggatctgttgagcatgtcttccaaggacagatttggatagtaagccaggtagaaggccagagctcccacaaagctgtcaccagcacccgtggtatccacagccttgactttctctgtgggaatgtgctttggctcaggttctgtctgtgacagcaccacacatccttcagcccctaaggtaatgattaccacctggcagccccttttcaagagcactaatgcagcctccccagcatctgcagcgctgcccaccgtgaggccagttaaaatctcagcctcactttcattgcagcagaacacatctgagagggtgtagaactggggatccaggtcagcaatggcaggggctggattgaacaaggttttcact

SEQ ID NO: 2560 - DNA, 706 bp, Homo sapiens
  ref <308>: DATABASE ACCESSION NUMBER: Contig54414
  ref <309>: DATABASE ENTRY DATE: 2001-06-18
gttcaaaaacttttatttactataaagacaaaaacaccaaaataggtacaaatactataaaatcggttcaatggggtaaaaattttaattaaaatatctcaatatatttaaaataacaaaggatacatttaagccaaattttcttaacccagagattttttttttttttttttgtaacatttgcttacacagtaaggtgctaatagaagttagcccttaagccctggaaatcttaggaatcatagtcacacagcaaatataatttcattgtgaaagtgaactttggtagaagaaaaatctataggacacctgaggtagtagaaactggaataaacagtagtagacgttatttacaacttgagtaccaaataacattaagaacacaaaaataattacacgatacaatttccagtccagctttgatccaaagaaaataagaatattacatcacatttgcattgaaaacaaaacaaaaaacaaaacaccacaattaccagcaagctgagggaactgcaaacaaactcaaacacaatggattttgaaatctacagatagtttgagtttgaaatgtggtgggcatggtgatctacaaagtaatactgattagctgaggttcctcagtttatacagtttacatttttgtcagacacagtattcatctgaccaatgatcttccagtacataaaatggcaagagtgcatccttt

SEQ ID NO: 2561 - DNA, 1132 bp, Homo sapiens
  ref <308>: DATABASE ACCESSION NUMBER: Contig54425
  ref <309>: DATABASE ENTRY DATE: 2001-06-18
cacattcacataatttttattacaatatattgttataattgctctattttgctgtgagctgttgttagtctcttactgtgcctaacttataaactgaactttatcatatgtacgtacatacaggaaaaaacattagggtttggtactagcagcggtttcaggcattaactgggggtcttaaaacatatcccccaccatgggccaggtgtggtggctcacccctgtaatcccagcactttgggaggccaaggcgggcagatcaccaggtcaggagttcgagaacagcctggccaacatggtgaaactcccatctctactcaaaatacaaaaattagccaggcatggtggcaggcacatgtaatcccagctactcaggaggctgaggcaggagaatcgctcgcacctgggaggcagaggttgcagtgagccaagattgcgccattgcactccagcctgggagcctccagaccaaaactatgtctcaacaacaacaacaaaaaaaatgaaggccgggcacggtggctcatgcctgtaatcctagcactttgggaggccgagacaggtggatcatgaggtcaagagatcgagatcatcctggccaacatggtgaaaccccgtctctactaaaaatgcaaaaattagctgggcatgtggtgcatgcctgtagtcccagctactcgggagactgaggcaggagaatcacttgaacccaggaggtggaggttgcagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttcc

SEQ ID NO: 2562 - DNA, 522 bp, Homo sapiens
  ref <308>: DATABASE ACCESSION NUMBER: Contig54477
  ref <309>: DATABASE ENTRY DATE: 2001-06-18
gaaaataacaaaaaaaccaaactttacttgcatttagccattaataaataatttacagtatgtacacgcggtgacactccacacaggtcgcagacacgtggacgcagtgaggggtccccacttccaagcagaacgtgagcaaacacaaccaaaataaagtgcttcactttttacttccaacatagggaccaactaaaaccagcagggagagggaggggccgggccccgagcgccctcccacccgcccacacacggttctggcagagggagcaggacctcttggagggagggggagacacacgttctgcagcctcctggccagtgtatgagaggtccctggggaacagcagaggggctgccgatgggtgggtagggtgtggagctgtagggctgctggcaggatcaccctccagggcctggctgcacttttgggagtgaagcctggctttgtgctgtgggcatagcagcacaggtgggactgttctgggcccctggatgagcaccctgggctgaaatgagcgg

SEQ ID NO: 2563 - DNA, 547 bp, Homo sapiens
  ref <308>: DATABASE ACCESSION NUMBER: Contig54503
  ref <309>: DATABASE ENTRY DATE: 2001-06-18
aaagaaatatgtttatttaaaacttacactgagacaattagtagctttaacagagaacaagatagcttcaggaacataaaacaagctattttacaatgtcatgtctcaaggtgttctaaatgctacatctcctctgacttaaggggagatagtgaagattatattttcagtagagtagggacctggatactactagtccaaaaaacttactgcatcaactcaaactaaatgtttattttacaaataactcaacgagcccaagcacacggatcataaaatcttcaaacacctagcaagcactacttttcacgagtgcattatgcaggaggactaagttaacaagtgctctgcagtctgtgcttcaatgtaagacattcgtagtgatggtcactgagtaagacaaaaagccctacaagtgtaataaacaaaccgcagtgattttgctatctaattaaattacttgaagcaaaatgactactaggttatattactgttattatattacatcacccaactatgagctgttctgtttccaatgaccagaaca

SEQ ID NO: 2564 - DNA, 581 bp, Homo sapiens
  ref <308>: DATABASE ACCESSION NUMBER: Contig54534
  ref <309>: DATABASE ENTRY DATE: 2001-06-18
taaacaacttagataatttatttagaaagtagaaaataaaaagtatgattctaacatctatttagaatatgaacaaaattagaaatggttaaactacagaaaaaaaggcagagaaactgaagttggcttaatggttatccaatacaaacaagcaaaacccaagttaccttcatgcaaataagcattaaggaaaagaatacgggaatgtttacagaatgcgccatggcaaacatttttcaaatttacataagatactgtacataaatgaaaaaataaattaggtaatttacaagaaatgttttacagattacaataggctataacttagtttattatgaataaaatttatggcacatcatacatttttacatcacagattcagtgttaaaagaattcagacatgataaagcttagacttgacaagaatgatgtaatagaatgaggcaactgaaactgaaatggcatgtgtaagtaaaattaatccccaaattaaaggattccttagattgggacataataacatcttctgagtacactttggtcaataactggtcattaagataaacgccattcaattttag

SEQ ID NO: 2565 - DNA, 927 bp, Homo sapiens
  ref <308>: DATABASE ACCESSION NUMBER: Contig54547
  ref <309>: DATABASE ENTRY DATE: 2001-06-18
aagcgaaaaagctaaaagataattttttgttaagtaatgaacactcgtaaaacagcaatgaaatggtattaaaatgtctgtgattacttatttctcagcattcatctggtaacttaagcagcatgaagcaagagttgcactttaaaaaatgacaagaaaatagctattcatttagtcgacagagtaaggcccatctcatttccaggatcactagtttctgcttatgacggggtgagcatccgccagcgcggtgattgggaggcgcccctgtgtctttaggctgaggcagtgcccatagctgcagtgcctcgagtttccggagcaaccgcggggctctttcttgaggagtcttgggaggggcggtggcctgcctccccatcctagatcagcgaggtcccaagagtgcgtattgctgcggggtagctgtggagtgtagacacgttccggaggtggcttgacatcctgaggctggggtggtgtgaagggaaagaaagaggggcaggtcccgggctttgctggctctgcttctcagggtcaggccaatgggtctgcagagcagtgcagcgggctcctgccagccgtggtgttgcctctttcttcccagccccattctcgtcttgcagggaaggcgtgtggactccggggggcacaaaggactccagcagggccacagacagaagagtgatgtgtcccttgtcctctgcctattgcaccgtattccataaaaaataaacacttttttggactgtttgtatattgctaatgcggtggcactctgggcactggcaggctgcagagagccgcgttgccattcatccaccagaatccatccagagacagccttgcgggctgggatctttggagctttcctttggaaggattagcagtgcccgtctgtctggtgctctacacagtgctgtgaacatg

SEQ ID NO: 2566 - DNA, 519 bp, Homo sapiens
  ref <308>: DATABASE ACCESSION NUMBER: Contig54560
  ref <309>: DATABASE ENTRY DATE: 2001-06-18
cgttatgaagatattttcctttaatttatcaaacatttcacattcatgaagtcatttacttcagagcaaatgtaagcttataatattaaaaattaaagtattacaatatttacaagatggttggcaggggacacttactagtataaaaataatacaaatattgtattttcctcttatctgccagtaaaaatggcaaacagttttgtctttctgaagtttctagtcaataaccaaagatgaggagcccctaataaagtgccttgccctgtatgctccactgtctatagctttagaccctcaacattcttcttcaagttcagcagctctttttcttgccttcttttctccagtttaaatgctaatttgttagctttcttctccactcttcgttccttgcgctcttcttttatagcttgctttcttgctcttttatcttctttgctttcatttttagaacgtggctgagttgatactttaggaagatcactgccattaatcatctgtattctttcagtttgc

SEQ ID NO: 2567 - DNA, 1021 bp, Homo sapiens
  ref <308>: DATABASE ACCESSION NUMBER: Contig54581
  ref <309>: DATABASE ENTRY DATE: 2001-06-18
aaaatatcaaaagaagtttattaaaatacatattttgttatacataaaacttagaaatatttcaagatttacatacatcaacttttgcaatcttcctgctggtaaaaatacaaaacagcagcataagaaccagttactcatatactcaactatattcatgcatacttaacaaaatgaaaagttctcctaaaaactggcaagatacaaaatgtcaaatctaaaatgatatatatacttacgtttttagcattcttacagattacaaacccttaccaacattaatcttggcctactttaaagttgagtgatagcatgaactctgaaaagagaatgcatgggttttctcacagctatatggccttggacaagtcacttgtcagttccctcatctacaaaaagggggttaaaaatattcacatcacagaaatgagattaagtagtttaacacataatggctaacatttcattgcttacgtgtttttgaaactacagggcacttttatggtgtgactagtattttaagtaatcagtgcaacttagtatttttatctctagctgagtatgtgtctctccttacctctactatgccctttaaatgttctttgcccacacaatagttaattgtgctaggtataagtctgattctaataataaattgatataatacagtcatcttagtgttaagacttattctcagtaggtaagagttttagaactagttccctgaaaaagctgtatttatgatagtttatgtgcaatctgtagggccaggagcatagtctaatctgacccagaatgtctttttgatttgatataggtaaggctcttcggtgatccaagagcagccgctttgggatttctggaaagcaaatcaacctgcacttagagttgcatggacagtgggccaaaagtcgtaacacatgcatcataactccagtccctgttaaagggaactaaagggctttgatttaattggccctcttaagcaaagctaataaaagattaagttgttgggccgggc

SEQ ID NO: 2568 - DNA, 1032 bp, Homo sapiens
  ref <308>: DATABASE ACCESSION NUMBER: Contig54609
  ref <309>: DATABASE ENTRY DATE: 2001-06-18
aggagatatttaaccttttattgtcctttagagcacatctcaatttggactaaccatatttcaaatgctcaacagctacatatgggtagtggctactgcactggacatcgaagttctagaactctctcttacaaatgaacactatcactgtcgttgaaaactttcttgagatagtttattttatacaaacaaactgtatttcttattattcctgaaatatctcatattggcatcctgccatttcattgtagtgcctatcatttttccattgatactgataaagttgcctaagacacaacttcctacatagaggaaataagaggaacaaaccccttttggacagaatctattaaaactcattccactatccctatgtacataaataacattgcctctgctgagtggaatttgcattcgttacttcaaaattcagactcatctacctttccaagttagacagttggggaaagaacttcctaaatcttaaggttgaaggcagagggctcaaccccactccagattcaggcaaggggaataggaaagaaagtgcgagataagagcatggtggcctcttggggtcccttgatgggggctgttgggaagtggaaggcattcttttaaggggataagaagcaaatggaagacttgctccaactctagagttttcagagagttagaggaggtggagagatttactcctgccatggatcatatgcacttctaccatcaactcctggttttgcagtatttttataaatggagtttggaccttggtgacactcagcctctcttccccttttcctatgttgctcaatcttcctttccctcctaggttcttacacatttcaaacccttgccaataacagtattttagttatcaggtctcaccattccctctggttgttgagcctttggataaaaatccacatggctatggagtgggttttgttggaaaaagtgaccgtcctctaactgcacctctatttctggctcctcaaacagcaaagggtaataataaggcatggtagaggt

SEQ ID NO: 2569 - DNA, 648 bp, Homo sapiens
  ref <308>: DATABASE ACCESSION NUMBER: Contig54666
  ref <309>: DATABASE ENTRY DATE: 2001-06-18
cccagtatacagagtctttatttattggaagtcctgatatccaggaaagccgggcccatgtccagggctcaggactccatctggccactctgcaggggaggggcgggggggcagtcattcatgtccagttttcctgccgtcagaggagtcctcaggaggcaggaagtggctgtgcctccacagttgcaggtgagcgtggcggctgcacctgctcagcgcactgcaggaagcggcgcatatgctctgcacagttgcccacagctgcctcgttctgtcgaagacactcctcgaaggcctcaaaaggctgagcacaggcctggcggatctggcggatgattgggtgggaggatgtgcactgggcaatgctcatcttaaggtagtgacagtcccgctgccaggattccggcttggccgccacacactggccatactgctccagctcccggccacagtagcgagcggtgacctctagggccgcctgcatctcgagacctttgccggcgtagggctgtccggggggaacgacccgccttttccggtatcggttgtcatgcggcgcccagcccagcctggttttttccggtagccaattgaactaacaaccccgttccctttaggactaatctgtcacggcggcgccctacctct

SEQ ID NO: 2570 - DNA, 683 bp, Homo sapiens
  ref <308>: DATABASE ACCESSION NUMBER: Contig54667
  ref <309>: DATABASE ENTRY DATE: 2001-06-18
cactgaatgcataaagtcctttattgaaaatattgggatagcactgcattacatatagtcaatatccataaatgaagggtcacacatttctgaatggacaatactgttttacatagagaacacagcatctggatatgctctcacaattatagtatcatggactaaactaggtcagagtgaagtatatgcaaaatgaccattttgtttttttccattttattaatagcatatggttgcagatggtgtaaatggtaaacgtgatatcatgagacattcctgatatctcacaccaacacattatttaacgagcaggttaaggtgaaactgccagtatgctgttagtcaagagtcctcagtaggagaacttgagtgaaacgtacacccaggctacagatttaaaattttatagcattcatttaaatttgcatggaattaaggagtataataattgttgatctgacaggaggccactggacaatttgttctctttcacaaaatgtctaaaataggagaataatgtaaaggaagtattctaagaattgcttttttaaatgcagatatgtaaatagtacttgttatacatttttcctttcaaaaattaccggggaaataatttatgacagaccatttttcagctttggttattatttgaaattttttcctactagcaagcagtctttggc

SEQ ID NO: 2571 - DNA, 870 bp, Homo sapiens
  ref <308>: DATABASE ACCESSION NUMBER: Contig54726
  ref <309>: DATABASE ENTRY DATE: 2001-06-18
gaaagagaacagacttttaatgatatttttaaaaacagttcaggttggtgaagcagaaaagggatgtgattacaatttaaatgaatcagtcacttgcacaattaatcctcttggcatcatacaaactgggttttaatggcaaatgatgacatcatagcatgaccaacactcatggaaggcagtctagagtccatcacgctcacacctgagggggaaggcactgcacccactgacgagacgcagagaccttggactacagatgacaccacatgcccacttctccttcctcaccttcctatggctactcctagtcacctgggacccaggccttggctgcaggaacagactttttccatcggcttttccagggcccaggtgaagaggccacttcagcaacagagggtacaggagagagtttaggggctggtggagattaaagtgggataagtgtatctaaatagacttatgtacactaaaccaatgaaggagaggtttggctttaagaaataaatatgcccccaaccccagaaaccaagctgctgagtaggttccacaggcgagatacacatttaacactcaccctgggccagtacacttgactggtttaattctagtacatctgtcatcactatacactgagtagaatacagtggataagcaaaggtttctccaccatggagagagatttgtgttgccacaaactgtttctgtcacccacccgtgtggggacttctgagaaagttttcttgttccaaggagccatgtgactcagcgcgaggccctgcctcagcagaagctctgagccagaagccacatatattgctggagacaacatggcacaagggaaaagccctgaagaggacaaaagat

SEQ ID NO: 2572 - DNA, 936 bp, Homo sapiens
  ref <308>: DATABASE ACCESSION NUMBER: Contig54742
  ref <309>: DATABASE ENTRY DATE: 2001-06-18
ccttgtatgaaaagatttaatgaattatgagccattgatcattacaaactttaagccttaatatttcttctttcctatgtaaaaccaggtaattaaaacagcctgtctcagtatgacagaagaccatagtagggataatagtaacgtctgcttccacatctgcatgcttcgttaaccaaccaaagaaagtgctccaggtttcccaagtcaacaaagtatactcagttacactttccctgatcatactatgaattgaaacagaacactcctttgacttttaatagcacttttcatccacggcacaagcactttcccattattttctcctttaccctcaatatccttgtgaggtagtgaagggagggagcaaggatttttttttttctattttgcagatgagaaaactcaaggtgaattttacaacagtggttctcaaccttggcagcatattgaaatgaccagaaagtttttaaaaatccttatgaccagctcatattccagaccaacatcagaatcttggcatacggaacccaagcatcgatgtgtcttccaacattccaaagtgactacaaagtgtatacagccaacactgagaaccactggtttgaatgatttacactcaatcttcaggcgcaactgtcttctaccgaaatgctctcctcagcaccaatgacaaagatattccatctccttgagcactgcagcagtttaagattttgtagagctactactgggttttagtgacaaatttacgtaaatgaaggccctcatgacccagatgctcatgctgctcacttcaattgcatatgatttgcgaatgggacattcgggaatttaaatctttgagataagaatggcttgttgttaaatattgaggcaattatttcattctaggtccaatacgcaataaccatgtgtttcggttttccactcagc

SEQ ID NO: 2573 - DNA, 551 bp, Homo sapiens
  ref <308>: DATABASE ACCESSION NUMBER: Contig54745
  ref <309>: DATABASE ENTRY DATE: 2001-06-18
gtaaaaatacatcttttaataaacattaagaagtacagcgcacttttattgaggttttacattgtagtttacagcaaatatactatccattgtagtgtatatgtacaagtaaagtaaacttaggtttgttttctctcccatggctggataaaccaaatctgatacatccacatttaaggttgttttccaagttggtttccataaaaggcctttaacaataataggcttttaacaacaaaaaggtatccctcccatcacaatgagagcttgatgagggctcaaaagtgacttcaaaaactgtaaataattattttccttggatggctttaaaaacagctactgatagcaaatcagaaacactaaagaaaaaagacaataaggaaacagctgtttgtctagtgaatccataataaataccaatttgaggctatagattacaaagccaaaatattcttataggaaagttaatgtttatatttacaatcccatggactaaaaaaactgtctaatatcttaaagactgagtctacctttatttaacattgtttata

SEQ ID NO: 2574 - DNA, 934 bp, Homo sapiens
  ref <308>: DATABASE ACCESSION NUMBER: Contig54757
  ref <309>: DATABASE ENTRY DATE: 2001-06-18
catacaactcatttataatttattttcacacaactcactatgttacaaaactgtacacctgcccccaaagttggataacccaaagtcacattccttggaaagagaagaatcaacactgggccgctttttcaagagcagtctcttctggattgggcccaacaaggctagaccagaatgtggagtacaggaatggccattcttcaagtccgaggggtcaggttcttagcctggtgcttccagtcgttacaggaggggtgtctctgtttggaaagccagcaccagcacccagaacacaggagtccagagagacaggcaggcactgctggccaccatctggctgtggtgggaatgcccacggcgagggagccgcagttcagtggagatgtgcctgtccaggacagggacctggagttgcgggactatgtcactctcctccaggcggacccacagatcgctgaattgccggagtcgcggcctccgctgtgaccgcctccgcttcttccggaacctctgttcggcctcactgggcgtgtcggcacttccaggccgggacacaaggggaggcagcgttgagtgccctgaggatacggcttctggtgccggtacttccagggtagggacttttggagcaaagatggtggacagagtgggccgtgtggaggtctttttactcttccctttgtggatgggtcgtccagcaggggcgtgttctacctcatagccttcacgccgcaaaacatccagcactgtgttgttgcccatgaaatgaccagctccaaaggcaaagaagaagcctttgtcagggaactcctccaaaagggccttcacccgcttccctattctctcattccgcttgtagatcagctcccggcgtaagtagctgtcaatctcctgagcagtgatgcgctcctgaggtggtagcgtggcattaata

SEQ ID NO: 2575 - DNA, 555 bp, Homo sapiens
  ref <308>: DATABASE ACCESSION NUMBER: Contig54761
  ref <309>: DATABASE ENTRY DATE: 2001-06-18
aaaaggatgaaaacacagattacactttattttaaaactgaaatgaattttaatacagaaaatgaagacagcattttgcaaatttatcactcaaaggggtatctctatttgaggaaatcagcgtgttacactttgaaagatgaaatgttacagcttgtacaccaaaattaaaaaatgaaattaaattaaaaaatgaaatggttaccaaggtaatgcaggtcaggggatcaaaggtgaagggtcacacattattaaaaagaaatccaaaaggacggctgcatcatgatctctcattagtgttccagcggtgcctctcttttggtaaacttgaacatttcggcagacattcaagcagctttttcggtaaaaagatttttacatgactactattgctgttcccatgatcatcttctataggtggcacggtgttgagaacacagtaggtgctagttccgcagaatacactttgggaaacgctcttccggcttgttttcggcagccatttcccctccgcgcgccacatcctcctcctcctcgcgaccgggaccccgagcg

SEQ ID NO: 2576 - DNA, 1048 bp, Homo sapiens
  ref <308>: DATABASE ACCESSION NUMBER: Contig54813
  ref <309>: DATABASE ENTRY DATE: 2001-06-18
aaagtttttaataaacttttattttatattcaagataaagcatatacacaattcaatgtggaaataaattactagaaatactctggaaacttttccatttccctctcaaactcacttttttttaagctcataagtctttttacttgattttaagaaacatggcaactataatactaagaaagaactacagctttgtacagaaacatagagccttgtcttgactataaggtttagttggtgttttaataacaacaaaaaagcacaaaagacacaaacactcttcaacaggtttactcaaacagcttcgctcaagaagaaaaaggcacagatttaaagggatgacaataatcattaagaatgaagtaaatggagactcagtcaaaaaatgatacttcatgaattaagtcaagaaaaacaaaagtctttcaaattatctgtcttccttaaaatgaatttttaaattaaattgtataaacatatgatataaagttggtactttaggaagcgtctttgtatattttttatgtacaaatctttgtatacaatttcgatgttccttatatattccctatatagcaaaccgagccaggacctcccaactgcatgcctcaagtccctgtggagcactctggcagctggatggccctacttgctttctgacaaaatagctggaaaggaggagggaccaattaaatgtagtcatcttcaactggctctccattgacatcacaatagtggataaaaattgccactactcgctgaaatacacccttcttcatctgacgcatctctgaaatttcctctcctattgtttccatacagatgtctgcagacagctgtcctttccttctaggagcatagatagtgctttcttcatcgtcttcaaagtcgtatcgagcgaagctgttgggctctgcagctcgtaatgacctcagccaagggaagtcagaaatcatggaatatggagctccatccacaacaccttctaaagtatagatttctctccccaggggtacttggggtatttctttaagtcttcttcacttcg

SEQ ID NO: 2577 - DNA, 1307 bp, Homo sapiens
  Modified_base 1 ... 1307: n = a,c,g, or t
  ref <308>: DATABASE ACCESSION NUMBER: Contig54867
  ref <309>: DATABASE ENTRY DATE: 2001-06-18
gcaaaatgacaacatttaatgggatgataaggaaataagacttgacaagaaaccatagcccactgcagactgttcacgatgtcagatggttcatgatttttttccaggtttgatacagaagaatcagtttgttacaagaaatgcttctccaactcttctagtaattgctttgtctcactcggaaactgaactactgtcgatgttgtaaaaagctagggcatattcttctttttcatagtaatcgtagaccatggctggggctggctgaatgttgaacacaaggttgctctgctcaacagaaaaagggaaactgtctgctcgaccaaaaccattttccaagtagaaaagaacatggtcattcttgacttcagtcttcatcacttggcccttgttttcaagctcttcaatggatgacatggttggagtaaatcctgatagcatttttacatctataaccaccatactggatttattgcgaattccagtgtatttgagggtcactgtgaggtcaaaagcagtcgaagagtagttctttactatttccaaggaaagagaaaatccagatgccttcttaggtaggagaacattgtacttaagggtggcctggataaatgtacaaccgtgtccttccacatctactgtgtattgtccaggtgcctgtgttacttctgaacgttggaccagtaggcggttatgaccgttaacctggaaaatctcactggatccttcactgctggaggactgtgggttttaggtgtccaagaagaaagctcagatctgcgacgcaggtgccttacttgggatttactatccgacaggggtctggaggactgtgggttttaggtgtccaagaagaaagctcagatcttccagcagaaggtaccttacttgggatttactatccgacaggggtctggaggactgtgggtataggtgtccaagaagaaagctcaaatctgccgacggctggtaccttacttgggatttactggaggactgtgggtattaggtgtccaagaagaaagctcaaatctgctgacggcaggtaccttgcttgggatttactggaggactgtgggtattaggtgtccaagaagaaagctcaaatctgccaacggcaggtaccttacttgggatttactctccgacgggtcgatgccacccgggaacagaaagaaagcaggtcatttgcaatctaccggagcctggaggactgtgggtattaggtgtccaagaagaaagctcaaanttccaacggcaggtaccttacttgggatttactctccgacgggtccgatgccgcccgg

SEQ ID NO: 2578 - DNA, 1025 bp, Homo sapiens
  ref <308>: DATABASE ACCESSION NUMBER: Contig54895
  ref <309>: DATABASE ENTRY DATE: 2001-06-18
ccagagacaacttctaagtttctctttatttcttttggaaacaacctccattcttcatctctcaatgtagtcctggcctagtgaaaaagaaggcttttctttctggcctccagagactgcttcctttgtaggaaaaggaacaataaacacttcccattaggtttctgtctccagataccaatcagggaatgactggccaggactggaacttaacggccttgagaacatgtgggatttgtctttgagccccattggcttgtgatgttttcctctgtcctccctgagacagttgctcctgtcctggggggctctgcctccacctcccagtccaggatgtctgaggtggttgcaggctgcttgctgcccagtttccagtctgttctggtccagggaagcaccaccccatggcccttgctgcttctggcaggggtcctcaagagctcaccatgtcccagtgctggctcatgagtgaggactcacatgggttgacgacgatttccttgccgttctcggtgccatcaccgaacatatctgtatcgaggcagaggtgggatgctatgtgctcgatgtgggaaccagttttggtccattgctgtcggtcatctccattcttgcaaaggacaagaaccactggggcgccagggaacaaggtgatgactgacaggcacagctcctcctggaggatcttctgggtgtatgtgaaggcccatacctgggactttgcatcttcgcctttgaccttggcacaggggctcaactttaggtttggggtttcttggttgttctgcctttgagattccaggcacttctgtctctgtcggatattgcccttctggatggaggactccttggggatgctgagttcagggtagatattctccaggtaccacttgaagctctggcagcgcagattcttcctcaggtccaatctgctctcaacattcccgaagggcctctccagggcgaatggccgggcagcgtaatagtattgcttgtattcatccatccacacttcagctgtccgc

SEQ ID NO: 2579 - DNA, 1176 bp, Homo sapiens
  ref <308>: DATABASE ACCESSION NUMBER: Contig54898
  ref <309>: DATABASE ENTRY DATE: 2001-06-18
cagattatagctgctgttaccttttattgagtacccacaatgtgctaggcaactgtgctagatacttttacataatctcatttaatttaaccctcacaacaaccctgtgaggtaggtatttgctccattttacaaatggagaaatcgaggcacaaaagattaaacatcttaccaaagtctgcacagccacttatatgctggagctagaatttgaacccaggtgtgcctccactttttaatactagaccaatcttttcacgggggaagtttcctagattaacaccctcacatcttttaagaccattccaaaacctgcgttctgttttgcagaagccctcactgtgtttctgctgccctgaaacagtggaggcagacaaaggtgagtgccaagtgaggaaccataagaagtggtagatctctgtggagtgccataagaaccctcaagagccttaacaaaggtagttgggggagaggggaagaggtgtttcagcagctctgctcccagcagccatttcctctctccagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcaggtaagatggagtgggccttagatactctcctgaagagctagctattttaaggaaagagcaattcaaggccattccagacacacatgggtctgccattatatttggtgaggaggtagaacaggtctaaaagctaaggcccttcatattctctaaccagagcctttggttacacagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttcgagcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccg

SEQ ID NO: 2580 - DNA, 1759 bp, Homo sapiens
  ref <308>: DATABASE ACCESSION NUMBER: Contig54913
  ref <309>: DATABASE ENTRY DATE: 2001-06-18
gaaagaatgagggaagtgtttattgagactgaaatggaacactcttctcttttatgagttaacagcagtgtgttaagaggctggtttcaaactgactccaaaatgataactggcagctcatgaacagctctgccaactagtgccactaattggggcaacctagtaaggggtagaaccatttagcccaagataaattactgattcaatttcatttatatttagatttatttcctataaacaatagcaatatttgcattttaaaattcacattgaatcattatttactatttatgatgtttacataacaattcagtatcattatgttgtagatttcagatgtaggtcgtcaatactgagcacttatctactcttctgctatctttggcacaatttctcatttcttaaacatgaaagcacaggtttaagttggctacagaatactgcagaaacatgactattttggatttcagtgtaagtacaagtttatgttaagcattatttacaagatgagaactgaagtacagactataataaactatcttcataaattagcagaatgacaagcagaggatgtaatgaatagggccaagattactagttagaacagtcctcctggaggaggagacaagagtcatagaatggaactatttcccccgaaccactgataccagcttatgtcgtgggatttactctgcaacaacccaggttaggggaagctctttttctgcaacgtggcttgttcaacccatggaatctttattaaaatacaacttagttggtagcttgccactgttatttgggccctgataacagaagtgcaaggatggcaaagtactggcctctttgagtatgaatgaacttggaagaataaagccttccagttggatgaaagcacatccagccttttgtgagtgacagctttgtatgataatcttatgcagagctgatatggattccctccaggcagctcaaatctggaagttgtaaatgacatggctatgccaccttggagtatcaccataatacatctctgctttagagctgatatacagatgtgaaacgatcgaacaacatgatttctcattctagtgctccttagaaaggagttctgataagccccaaagcagacctgggttggaatcgtggttattattcaagtacaaggagaactctttatttcacattgacggttcaattctgatctctgtctggcaaattatatgaaaataataaatatatacatatatatatatatatagctctatgctgaacactgggttaacagttaccagcgtcccaatacagtacattgaaaaaagaatccttctccctttcttccaaaccctatgcccatcttaaaactgttattgcagaactatgctggtctgttttctttgaaattggctggagataagttaaaaattgacattttggcacattaactggggacaggtggtttagatgcattataatttataaaaaagtgagaggtcaaaggaaatccatgccaatagaaagcctgagtaaaaatttgtaaccaatgacagaatattttttttaaaaacccaaaacacttgtctatgcatgagaaagcattttctctttcatatccattacctaattctaacagttattactttatgtacttccaaactttgtctcttatagaatttctaaaacccagataatagaactttcctttaaattgatttcccttcaacttaccccacacccaaatcccaaaacccagagcgcaaag

SEQ ID NO: 2581 - DNA, 1001 bp, Homo sapiens
  ref <308>: DATABASE ACCESSION NUMBER: Contig54916
  ref <309>: DATABASE ENTRY DATE: 2001-06-18
caggagttcattccagttattttaatgttatttactagcagtgtgccctcgtgcacattatcaaactcctctgactcttggaatcctcatttttcaataataactcacaaagctgtcaagcctaagggttctaacagctcgaacagcacctggaacagaagcaatagccgccactcagaggttacttcttccttctccgccttctctggatcacctccctacctcatcctcaatctaacgctggaaatattggatatggggtaggtcaccaaatgttgccagaagactcaaattatgccacccatatctcagctgggaagggcttaccgtggcctgactctcctcagggtccaagtccccatttatgatgtccaggcagaaacacttgtttctgacacatagtaggcgctggaaaatgttagtcaaatgaacgaggtctggtgtggagagaagagaaatcttgggagagtcatttaagggggtgcccagttgtcctcataaaaaacactatcatcatcagggtgaccaaagcagacatcataggcagggggtggagtcagaggctctaatgtggggactgccgccaagctctgcagatcaggagcagtggacacagcccgtggtccccgaagccgaaggttgattggagctcttccagggcttccttcctgggccatggacccctctgaggccattcgcctctgttccagtttggctctcctggacccctctggatggctaggttgttcctcctcaggtgctgggggtatcacaacagtgctgtaggggggtggttggtccaactcttgggggcggcactgggattctagtcccaccacggcctcttcatagactggcacttcaaaggcttcattgtcccctgtctgactctgtcttttcctttcctccggtgttagcccatgctccaggtggagggagaaagtgcacacaggcgcaccaaagccacagggacacaactgtctcagaagttcgtcgctcac

SEQ ID NO: 2582 - DNA, 756 bp, Homo sapiens
  ref <308>: DATABASE ACCESSION NUMBER: Contig54965
  ref <309>: DATABASE ENTRY DATE: 2001-06-18
gggaatgttagtgcaatttaatcaccgtaagggtgacttttaaagatacactgatagttaaaaaaaaaagacaattaaaaaatagcattttgttttttaaatggcacccattaaagactcaacagtcaaaatgagacaaatcagtcctttagacgttcacagacaattgaaaggcactttaaaaatccactttttaaactaccacttgagaacacatggtagcacagtcttaaattcatcctagttgatcgggaatgatgaatgagtgttggcaccagaaaatcctgcttgcagaagggggcgcaggtgtcggtccacgggacagccactggccaggctagctgccgcctcactccgcagccttctgtggctaaatggcaggacggacacacaggaatgggctttggaccacaagctctggcatatcgggaggcaaagcactcaagtactctgcagtctagatgacacatttcatggtttggaggacagaagtaggtttccacatcacatgaaaaggacagtgtcacagtggggttacccagtaaacagctaccaaagccatcatttcacgcttccctgtagttttatgagctcgccctctgcatgtggatatggggaaagccgggcatgaaggggtgtgtgaaaaagaacagcctctgtgactgactgcagtaagctcacaagtttgtcactgtcagacttagcaagtcagcctgcaaaggttgtgctgatctcttggccacactacctactcag

SEQ ID NO: 2583 - DNA, 1717 bp, Homo sapiens
  ref <308>: DATABASE ACCESSION NUMBER: Contig54968
  ref <309>: DATABASE ENTRY DATE: 2001-06-18
ttcattcaacaaatatttattgaacaactactctgtgtcaagtcctgtaccaggcactgaggatacaagaataaataaaacagtctctgccctcaaggagcttacagtctagcataagaacttaaaacacctcagaacctactgagaaaagtttctgggtatctagtatattgtctggaatactccaaatttcctaaaaatgtgaatctaaaatttatcaggaaacacagttgggcaattgaagatgcagtgaaatttaaaagaaaattcaaatattcaccctttatgtaaaaaccatgaaatctaaatgagggagaaacttaagaaagctgaaaatctacctattttaaagactttggaccagatttaaactttaaaaattattttattatctctgggtgacattttcatttatagtggcatttatatatacacatacatataggaggtgaatgtgagatatattccttagggcttttgataaaacccatatctttatccctagttcatttacaagagagcagcgtaatggtaactttgagattttccttttgacagtaatttccattatcatttgaatgggagaaattcttaggacatgatttggaatcatttctagaatataaatttcatataatcttattttataatgagacaaaactgtgtctttgtaacaatacgtgataatttaagcctatgttttaatggttattgacaaagtttaatggcatccaaaatactcttatgtctatctgaatttttttcctgtactcttcttttttcttaaaagcatgatagacccctctgcaaatacagagcctttgttgttgctttgctgtactttggtaccttgctgtttattccttagtctagcagcatccttagtttgtagtatatcttacttagttgcaactaaaaaaaattgctagcctaggctttaactgggagtttctattatctagaaggttactgtgaacctttcagaaaagtggaaagcaaccaaaagagctgtctcaaagactgtgtccccccagagtttgtccagctcttactgtagacactctgaacaggcacggttatctcatgtccaaagctcataacagcacattagaagaaagtggggagcctgttagaagcaggcatattgatagtgtgggagaagacatagcaaattacttagcagatattttaaaaattttaaaatccaacagcagtctgaggcaaatgattctgtatacctcagggctgagagaatcactttataacatatttgttatagccctttacattttatgaagtgttttacatacatcagagctggatacttataataatacattatgaatataactttaacttttcatcatgaaaatgtgaattatactgagcatgatgtttaagaagaaggcaggaaggtatactaacatacctgaaatactcacatcaaaaataattacaagttttaaatgttggcacttgagagatatacattagctatccaaaaattcatatgtacggtttccttcaagaccaacacggggtatcactgagtgaattttcacagcgctcagtgactgctggtcattaaatggggatgattgtcatcagtataagtatcacactatttgtcctgctaaatgcaagttaaaagatacttatggatgccactaccacatattctgacaaataagggaaacactaggcttttaaaagattc

SEQ ID NO: 2584 - DNA, 1334 bp, Homo sapiens
  ref <308>: DATABASE ACCESSION NUMBER: Contig55069
  ref <309>: DATABASE ENTRY DATE: 2001-06-18
gtcttttctatttttaataccgagccattacataatccacacagtaattgctgacttgaaaaactattggcaacattagaaaatccccagagttttaaacaggaaaaggattactacagcacaaaagcctttggtagtttcactgactagtaaaccattggtaatcgtcacttgccagtggaagtcacatgggccctgggaaacactcccctatctcagggaaagcaggctgggggaagggatgaaatgcagcctcagctgggaggaggaggctgctggtggggtggtgtgctgagctctgagtggggctccaacaagtgacctccagccaaaagtgctgaaggagtgagcttcaggttgtcctcgggccaccttttactgcttttgtttcttgctagggaatgagtgaagtctccagcggcccagtcctttccctctcggtttcccaccttcctacagcctccaacatattcctgtaagagcctgagggagggtggactactccagttaaatagattttataaagacacaggagcagggaaggctgcctgtttatcacaaagacctaatccactcctctgcaaggctttccagacattaggccagaaccacactatttaattcttcaataaaatgatccaatgaaagtttaagaaccagtggtttggtttacaaccaagcagaagttaattatctaattgagacaaaattctctgtatgtgtatgtgtgttgggagtgtgggcagtgtataagatacagaggggacagggactactctccctgattttgccacttctgccacaatcctaaccccaataatcaaggaggatctgaataaccacatggccattcattcaataaacatatgctgaatgccacataccagactaggtgctggggatgcaacacagcaaaatcactgccctgctagaactgctaggtcagtgaaggagagacattaatcaaaatattacataaacatatcattacaatgataatgaaggcttatgaggggaaggtacagggcactaggagcatttagaataggggtatcggattgggtctgagggttcctagattatccttaggactccagggttcttttaaatcagtaccccttcttcttcccctcaccccactccttccttgcttcctgtagttaatatttactggtttttttctatgaggaggataatgccaggttcttcacatgcatgatctcatgtgattctcatgacaaacttacaattcagcactttatgacaaaggatttgctgagaaaggctgatccacattttgcaaggagaactatataaaatttatggcactgatt

SEQ ID NO: 2585 - DNA, 785 bp, Homo sapiens
  ref <308>: DATABASE ACCESSION NUMBER: Contig55181
  ref <309>: DATABASE ENTRY DATE: 2001-06-18
cattcatcagacattttaatgagacccaatctgatatgaccccttcttgggggtagctcatcatccaaggagaaacaaacagttacaatgttacaatgcaacttgctaaatattgaacagaggtaattacataaagctgtgttcccccagctgctcccctgcttgtgctgagatcaggagagctgtaggaaggagccacaggggtaaaggatgacccactccagctgttggaatatgagatgagtcacatctggaaattctaatttggtgcagctgcccaaggcaaagtggtaggccttgttcacatttaactcggtaaagctttatgaagcacctacccagtgggtgccatggaggtggatcagattgagccacgctgctgccacctctgtggagggaggctggcatggatacaacttgatgactatagactcttcctctctggattcagttccctctttctagcctccttgaatggcctcagctcattttgtgaaaaaatgctgactgaggcctcatggaagttctgtgccgattcttaggtgcctgtgattcatctgtgcctgatgagaatcagggtcaagtacggcccaattctccaggcttttccaggcactggctgcctgaagccaatccaggtctgccaggtagagcacaagccagtcccatttgcacttcctgctgctaaaccacaggtccctgcttctccttaagagcaaccttctcccagagctgactacacttatgtctcatacccagcttgaaccaattttccaaatacaaga

SEQ ID NO: 2586 - DNA, 924 bp, Homo sapiens
  ref <308>: DATABASE ACCESSION NUMBER: Contig55188
  ref <309>: DATABASE ENTRY DATE: 2001-06-18
actgccataaagaatattatttaatccatgagacatcgtccgtacaaagttagcgttacttttaaaaatgaagaccgtgatataaactggtaaaaaacgggcctgatgcgcctcgagcactccctgggagcaggccctggggtggctccgcccagtgtcgttctacctgaggtctacttgtgtctccccccttgttctctgcccccagaccatggccaaagcctttcccacaatgtcccatctgagagccttatggatgggctcacagggcagaggtaggaggagaaagaggaaggggcatggtgggcacccagccctgggggcaactgagggcacagccacgtccccagcaagggcacgctccagtagtagtgggggagaaggcaccagcagaggcagcgctgaggacctgggaagaaaaggaccctgccccaggagatggtctcagcaaggagcgggatattaggaactgagacccaagactcagagaggcaggtgccttgggtgtgcctgagcttgggtcaggatctcacaggcctcacgccccagaaaaaccccgccttaaccaaccatctcacgcggagtcagcctcgcctggcaggggggcacccaggtccagagcccgggccctgtcttgggtctctggctctctggcacacagagagcgctctgcagagggcagccctcgcaggcagaccctgttccagcagggctgaggggcagccgtgtggcccagcggtcagtgcagcacctggtccagctcatacttctcgcagaagcggctggtgaaggggaagcaggtgaggtgctcgatccagggccagttaatggggtagatgtacagccacagcacgagggcggcgaagaggccggcaaaggccagcagtgacaccaggatgagtgcccgcttgcggtacttgtcgc

SEQ ID NO: 2587 - DNA, 892 bp, Homo sapiens
  ref <308>: DATABASE ACCESSION NUMBER: Contig55221
  ref <309>: DATABASE ENTRY DATE: 2001-06-18
ccattggtttatttgtatattggtccacaacacattgaagcctcacagttccaagaattttttttttttcatatttgtggcaaactgaggtagagacaatgcttggcacagaataggtactagataaatattagtggaatgaacagccgaagcgactgacttctaaatggagcagattgctcatttcacttctgttcctccacctcaacaaacctttacatcctcactggtttgtgaggccagagaacaggtgtggccttggtgtgataagaaatgctaattttatacaaactgaagcaatctggtctcaactttgacccccaaatgccctcaaaatggatcaatgagccagggaggcttgaggaaggagggagcatctgcccttccccctggccagaagagaatttgaatttgctttgagtagcttatgggcagggctggaaggtgcagttcatgactgtcagcagctttgaggctgatggaggcatggggaaggattaggggcctgggagaaagcattttatttccctgtaccccaccaccccaacatgggggagaaaaacacaacagcaaactgaacagagcagaggccgaggcagcaagaacccaaagacggaagctgcttctagcatcaggctccaggatgcaactgcggctctcagctctgccggctgagcttccagatcctgcgaagcaagtcaggttccttccttccctgccaggctggagtaaggaggctgttctaggcaggcagtctgcagctgctcaccaaggtctggaacaagctgccttccttctttgccgagcagatgtggatggcggtgggcctggctaatcaggggtgttctgctccggacaggctcatctagatttccatcctgccaaaagtttg

SEQ ID NO: 2588 - DNA, 895 bp, Homo sapiens
  ref <308>: DATABASE ACCESSION NUMBER: Contig55254
  ref <309>: DATABASE ENTRY DATE: 2001-06-18
catctgctcaacagctcaaattatttattgtcaaaccatgctgtctatgcttaggcctttaggactactagggtcgtgggagcctcaaagtgtattctgcttggtccaggccttcttgggcttgatgttcatgcgtttccagacttcagctgtggtgcggtctgctttggtgaccccactgaagtcgaacgtggtgatacgggacagggtgcacagcacatattgcctataccctttctcttcctccatggggttcccatggagtgtcaggctacggagccgaggaaggacagccagcttattcacctcccccaggcgctggatgctgttgccgtgaagatagaggacactcaggttgaagaaagttgttaggacagggtcaatggaagtcaggtcattaaaggacaggtcgatccaggccaggttctctgggtgctccaacagctgtgaagccacctggttgaagtctctcagatcattgagaacattgttattcagccacagggactgggtcagtgatttccccgactttgaacgcttcagtggtcgtagtcctgtccttggctcctcatttaccagatcttgaatgacgtggatgcttctgaaggagtagtcaagagggggctcctgtaccgaagtgttcatatagtcccgtttgttcatagttcaggccatcattcaaaggtgcaagcaggtgccctgggagtctgggttcagcctgtcactgatggctgaaactccaccattaggcattcattcctgtgggttcagggattgtttccggttaaaatggaaatactccacgcagtcgcttcctctccagtcttggcgtcccactgcctcagggttactcagagcaactccatggcaactgctttcgtcaccacaacccggc

SEQ ID NO: 2589 - DNA, 1520 bp, Homo sapiens
  ref <308>: DATABASE ACCESSION NUMBER: Contig55265
  ref <309>: DATABASE ENTRY DATE: 2001-06-18
catttatggctcatatatactttatgcacatagcctgaaggtaattttatgatatttgaaatcattttctatataaaacagtttgtgtacattgaaccataagaaagcaaatgtgtttgttaggtgtggaattttccactcatggtgtcatagcgttcaggaaggtttggattttggggcatttgggggttttaactgttcagattagggatgctcaacctgtatctgaatgggaaataaagactatattggaatgagcgccttctatttcttcttcaagtggctgaaggtatcatcctaagtctgacatattctcctgggatattgctttaaatatagaaacgcttggggcaaaagggaatttccctccataattcaactgttaagattctttctttgaacagtaagagactgagttcttgcacttgggtgaagaggccagactgagaggctctaatcctagcaacatcatgccctggtctctgatttcatattcatacagagggatgcagtaaaaaatccctttctctccattcttaaaatcagtggctttcacaatacatcaggtatttggcttaatctctgcatttcagatagaataccagtcatcttagaggctgaaatagggatcaccatgtcctactgaatgctctcaaaagacacctgcagcgtgctgagatccagcagaatctcatcaccattcaagcagactgagacccactcgcctcatatagaagatccctgacctcccggaaggttgaatggtggggcgcctgtgacagtaggagtgggctggctatgcccgtgtgtctacctgtgctctgataagaggcagggacagagcaaggctgaagagagccttgatcagctcctcaattccagtgtccttgaaccatagtccatctgtttgcaccctaggttggtgtccttgtcagtaaggccgagggaaaattcctcttgcctgtgtgacccaaactctacatgtctgactcaactcagaaaaagctggggagaagcccaggggtctggtaacttcacctgggagctgctgctgagggcacatatgtatcccggaggagctgtgagtttctcccccaactgagtagaggaaacagaggggaacaaggagggggtgctttgtaaggcaggtgtaacctggattaaaagacattgtactccaactattggatttctgagacctatattggaagagtcaatttagatggctagaaaaggaaaaaaaaaagaaatctaaaacagctttcaaaaatactaagaagtggcactaccctcattttacaagataccatcgatcttattttgaggtgaaaaagagccacaaatgggtcctttctgagacacagctatgaaagaaagaaaaaataatgtatccgaggaatttcctgtctgcccaggctgggcaaacactgattgcaactgagactgccctctgggatcctccgtctccaaagctctgtgtccagtggagaccaggaaactttaaaaaaggttaggaattg

SEQ ID NO: 2590 - DNA, 749 bp, Homo sapiens
  ref <308>: DATABASE ACCESSION NUMBER: Contig55313
  ref <309>: DATABASE ENTRY DATE: 2001-06-18
gacgttgatataaagggcttttatttttacagttttctgtattttccaaatttctacataaacatacacataaaagtcataaaaatgtcccttaaaatgacactccctccaatgcagggagtgaggaggtgtgtgctgggacgccagcagggtggctgctggcagctaatccctgtgcaggtgcagccactgctacactccagcgtctgaggcccctctgcactggcagtgttagaatggctgtctgagagccaaggctgttcacccgagcagagtcatggagctggtacaggcaggagccaaggtaagcactaggctggtgtgtgccctccagggggcaccctccttgaagcaggccctccaaggtactcgccccctgaggcagccgataacagccggaagccttcccctggggggacctggccatttgtggagcagggaaaggctccactgccagtggaaatgtgaggccagcagcccaggatgtctgcttcccagagtccgcgtgggtcagtgcttgggccagacatggggctgcctgcggtggcaggacagtggcgggctgcctgggctggagggaagagcacgccagcgccaggaggtgctggggcagagctctggggatcctccccggctcctgaaggaggatggaggaacaaacctagtaacgggacccacttgcactgcaggaggcaggaaagcagcctgtccctgtccctggcttccctgtgagggacacagactcagat

SEQ ID NO: 2591 - DNA, 1020 bp, Homo sapiens
  ref <308>: DATABASE ACCESSION NUMBER: Contig55377
  ref <309>: DATABASE ENTRY DATE: 2001-06-18
tagttttcaaaaaaatattgatctggatcagatgggctgataaggcccaaacacttataaaccaaagctgcaggtctctaaggtcttcagagaagctacacaaaatactatgatttcattagcatccacatatgtatcattttccacaacattttacaattctcttgtttcacagggaaggtgaactaattataatgaaatatcagtaatgtatcttaaataagtaacatgttgctggaaaaaatttaagttaaaatgcactacataatagtgcagaaacaaagtgcaggtggcaattttaagacatgaaaacaatgctgaatcagtagtgtttggagtgatacattttgcccatttttggccagtcctagaacagtactcaccacaagctgcatgccaaatatgaactaatgaggctaaaacactgaagaccaaatagaaccactctagagtctgtttcacaatgagatactcctccccgttctggaaacagcgatctgctgtagttcctatcctcctgtggcacctatccctgctacagtacctataaccagatgtcctccatcatccagcctccaggacaagtggtgctcagtgagtcacaacctgaggaacagctgctggttaccgatttgtattcctgtatatactcgacttgggtagccaggattttctcgtttgtcttgaatatatttacttctaaaaagactgttagtcttgttgggaggtgagcagaggaatgtttacttgctggagaacatagtaacaaacatcacttctcacccctcataaacagaaagcccattgtctgtgccgtgaaaagaggactaccttgtcaggaagattttacttacctctacaagaaaaaggactcgtattaaaatcgacctgtggttaccacccttagaaatgctgttttcagatattcctattcctagtcttagaggcagccatggaatatatagtctcctctgaccttggggtcaggaagaaagggaaatctattcataaaaggaattt

SEQ ID NO: 2592 - DNA, 836 bp, Homo sapiens
  ref <308>: DATABASE ACCESSION NUMBER: Contig55397
  ref <309>: DATABASE ENTRY DATE: 2001-06-18
atctgttatcagctttattagggaaaacatcaggtctctttacacgttgaacaggaactgctggttaacaagacacgattaacttgctaggaatggacaaggacagcgacaggatggtgcttcacagtgcctcctgctgatggcaccttcattctggctgcagaattctcccaggaagggtcccgggctcttcaggaggcatttacttggaagtacaggtcagcgttatccaaagttgtccagcctccggcctggcccatgtcttcaggcagctctgaggcaagaataaaagggacgagttccctgccccctttttacccgctggatcagcttctacgacttggtcaaactatctttctttctgtctgccatgccaggaaatccagtgacagcaagacccagagtcaggcacatttggagggcaggtccatcggccactcctcacttctgtgggctccgatgccagcagagccacctgagcggctgctacctcttgccggaggcagtttcttctggcctcacccacccaaccatggctacgtcagggcagaagggagagaagaaagagagatgagagatgaaaggatttaaaatgggcaaccatctttgaggtttcccacatctgcaccgctccacagtgtgaaaagggctttctcactttcacatgatccctgggggctactatccccctgtaaccaaaagggaaactgggactcaaagggaagaagaaacgtgctcaacatcacgcagcactaggtctatgtccagtgctctttccagggtaacaggttgcttctactcattttaaaggactaaaaacagaaaaacagcaccca

SEQ ID NO: 2593 - DNA, 1220 bp, Homo sapiens
  ref <308>: DATABASE ACCESSION NUMBER: Contig55448
  ref <309>: DATABASE ENTRY DATE: 2001-06-18
cccaacaggctctattaattacaatttttagctctgtacacgcaatgattggctggttttctttttttttttctttttcctttttttttttcttacagtaccatgggaacaacagtgattgacttgcaaagttttctgtctctatggaaaatgcaaaacagtactacagaaatacacaatgcactgtaagcagcggtttgctgtagtggtccaacaggtacaagcaaacattttggctcagctaggcagtaatccacttaaaccacatcccggggctacggccgacccaaccacagctcctgtgggatcaaaaagaatgggtctgtttaaaaataaaaattgttatgttttgtgctgctgtccaaaggactcaaaggacagagtcatgaggcagaagtttcccaaccagatctagaatcactgggaccacttccttcctttcccttctaccaacctagagacttggactatggtttcaaagtgaaattggcatttctaacaatgaatacccacagccctcacttctttaaatatcaacagagaggttccttccaccaaggctcattgcctcctccccagtttggcaaagggcaaccatgggcttctactaaaagggaggggggcatgctttccaaattggggatcttacgtcttcctcacaccaggcacactgtccccccattccatctactattcagcctccaatcagacgagacaacacgaaagatgcttgttgtctcttcctcgtagtaattgagcaaagctgtgatggcattgccttcaatgagattttatcagatgttggtgatgatcacgaacctgactgtctgtgcttgggctgtatttgagtaaaagtggccgacatttttgtctgtgtgccttcctgggccagggagagtacaaactgttttctgaaccaactataactcacaatataaaacttctttgtgtgcgcagtttagctataaatatccttcatttgcaatagtagtcttgtcatacagtttgcttacttttaggatcatcggcaaacctaatccatccccaagggtcctcagcttttacaaataaaactttgcatttttgctctttgcttttaagaaaaacttccgactacagtatagcactacatcactacatgacagtctatatcaaattaattaaacttaatcaataaattcccttacgtagagaaaatgatcaacagccccatttaacca

SEQ ID NO: 2594 - DNA, 1115 bp, Homo sapiens
  ref <308>: DATABASE ACCESSION NUMBER: Contig55468
  ref <309>: DATABASE ENTRY DATE: 2001-06-18
actttgtaacaaaaatttattaggattaagtcaaattagaaaacttcatgctccaccacttgtcatatttacctgaaatgacaaagttatacttagcttgagtgtaaaacttgtgccccagagattctgtttggaaagcaaaaaaataattgatgcacatagcagtgtgcctgataccaccacagtgaatgttgtttaaggcctaacaaacagtggtcagcaaagcatacattacttttaagctttgggtccaaggaagatgtcattccctacctccttcaaaagcagactcatcatagcctgggcacctaggcctggagcctattttttcgagtctaatatgaacatctggatttcaagaggtgctaggcttgaggtatctttatggcttaaaaggcacaggtcatgcagctgaattaaaagctatcatgttggtctctggaatgcaggccatgagtcacgccttgtaagggggagacctgaggccctgtccttggctcctcagtgtaacccacacatcattggctctgttcctctcgccctgctcctgcactgctcatcagctgtgaatgctggaattggaggacaggttggggctcctgcacagtctgctgccaggtagagagcaacacaggctgcagaatcctaccctccagcatatcgcggggagggggggacctgctgcacagccaagaagtgactcacatgcaggcaaggacgggaaggcttgttcttcaggcacaacgtggtatggggagaagaaacctggttttcttggaatggtcctactaagcttgaaagtggtgctgcatttagggcagggcacacccagccataggcaacccctttgagcgatgggagaagtagcataagaaggatgccaagaagaacaataggttcttcaactcagtgtgggctctgggaaaccatcagcagtgggtacggaacacttctctggctctgccctggggtcactgagagcaaatgggagtcaagtcctcaaaataagaaacttatcacttactaaatagctgggcattcccttcagcttaggagcaaaatgtttactctcagaagctttcttttatttttaaactctccttaatggagggaat

SEQ ID NO: 2595 - DNA, 896 bp, Homo sapiens
  ref <308>: DATABASE ACCESSION NUMBER: Contig55500
  ref <309>: DATABASE ENTRY DATE: 2001-06-18
gcagttatcagccacagtgatttattgagtgctttaataatacaagtgtacatcaactgatccacagtcaaaagtggcaggtccctaagaaatttacaagcactttaagtaaatcaaaatacatattattttgttcaatccaacagtcttctgcgggagggacagaaggctagtgataaacagagtctcagtaatgcacagtgattctgattgaagcttttgtacaaaaacttgttcccagtagcatgcacccaccaataaagacttcagtacaaaaaattaaccctaagcactacatttaagtagaaacgagatataattctgaatgtgttttcccaaagatcacataaaagaaaaaaaaatcaaaatcaaataaacaacaacaaaaaaaacaaaaccacacagtaatacaaagctttgtaagaaagctcttactattacagctccaacattgtttgcactgaaaacaaaagttcccatctatgatgaggtgggaaaaaatcccaaatctttcaagttaacagaaatcaacaagggaataaaatgagagataaaagagagcgtgggagagaggagggggggcaggaagaactgggatgggaagatggacaacataccatcacaaaatggttccaaatttaataaaaataggaaaataagaaccgaggtctggaggggtgggcagggctaccgatgcacttggtgaatgtgcttgcacagcgtccgcggggcggcaggcagcaggcccctatgtgcgtaccgcttggtccactgtctggccatccggtcatgctctgctctgttggtcatgtactgtgtggcgatgctgcccaccagagggtcagcagggttgcaatctgtaagaagtgagcagatggagaggagaactttagaaa

SEQ ID NO: 2596 - DNA, 1212 bp, Homo sapiens
  ref <308>: DATABASE ACCESSION NUMBER: Contig55538
  ref <309>: DATABASE ENTRY DATE: 2001-06-18
gcagggcactggcagttgaggttgtctgtttattggtgaggaaactcctcgagagttaatacagtgtaatcttttcccagaggtgtgtagagggaagggggcctagaggcatcccagagatagcttatagcaacagtgctttgaccaagagctgctgggcacatttcctgcagaaaaggtggcggtccccatcactcctcctctcccatagccatcccagaggggtgagtagccatcaggccttcggtgggagggagtcagggaaagaacagacaacagagcagacagaccagtgatgaccatgggcgggagcgagcctcttccctggaccggggtggcagaggaaagcctaagtgaggggtcagactataaacgttaaggaaccgagatgagcacctgcttcaagtgcacccttcctacctgacaaccagggaccagaactgcagcctggggacagcactgggagcagctaacagagcactcacctgccccagcatggccgtcgcagccctggtcctggcaagggaggctccctgtggagtaaggggagacgagggaagccgctcctggaactgtgagggagagagggatggatttgcccgtcaggcccattcacgtctgacagtacaggccactcagtcataaactcaaacttaactgaagacttcagaaacagagttcctgagtgagggaaactgagatccaagggcgcctgcacaggacaggaagacagagactcagagccagggatggggcaggaagaagccagtgtgcccagcgccacttgctggcctgcctggaagagcagaaccctggaggcggagacccagcccagagctcatggcaggggctgggcagggtgaggggcggaagtgctcagcaggcgcccctccctggaccctgggaccctatttgccccttgggtccgtcacagcatccgcagtcatcagaatcaggttgggcagggctgaatcaccgctgcctggggctcggagaagaaacaagagattctttggcccagagcagtcagaggtccctgaggaggaagaggccatcacccagaggatccctccccttagtcatcttcctcctgactgatctgaggggagcagggcgcccccttcaaacagagcacagcccaggagctgctccaggagggggcagtccccaactggcttctcgtgctgttagctcttgtctctgggggacttg

SEQ ID NO: 2597 - DNA, 824 bp, Homo sapiens
  ref <308>: DATABASE ACCESSION NUMBER: Contig55558
  ref <309>: DATABASE ENTRY DATE: 2001-06-18
cttcaagaccagattagtattttatttttcccttcctaacactcaaattcatggcaggtgaaaagataatagaacataatcaaactaacatataaacacaattcaaaaacgtttaaccatctattatagctctttgttgtaaaacacacaaagttaaacagaaacatctttatataaattatccttaataatctgtatacactgtaaaacaattgaaaattcacaccaagatcctagtgcaagcagtggtgtacaaaagtgcaaacaaggttagtgattaacaacttaccatcaatataccacttcaacatactttacattcagccaaatactgaaggtttcaccatggaaaaacacttttatcacttttaaagtaacttgactatgttcaccctgagtgctcttgcctcagtatggcaactgattatgagttcaggttaagagcaacaccagggaatacagaaacccacgttaagttggccattctgacatgaatctatacttgaaaatgaaaacaatcccaaagaaaacctgtatgtcaaaaacagaactgttcctgcctttcaccccaaaatatttaaaactaaatctaagccacttttaaaatgcatgctggccgggcgcagtggttcacgcctataatctagcactttgggaggctgaggcaggtggatcacgtgaggtcagaagttcgacaagcctggacaacatggtgaaaccctgtctctactaacaatacaaatattagccagctgtggtgcgcacgcctgtaatccaagctacttggaaggttggtgaggcacgagaatcgcttgaacctggga

SEQ ID NO: 2598 - DNA, 788 bp, Homo sapiens
  ref <308>: DATABASE ACCESSION NUMBER: Contig55606
  ref <309>: DATABASE ENTRY DATE: 2001-06-18
gtgatcaaagatgtttatttaaatgcagattttacaacctcaacttgtccctttacaacaggtcttcccagagcttttaatgtgcagacaggcatgtgaacctctgataaagagagggaaaatggagaggcatcttcctctgacttaatacaaccctttttacttttggtagaaaatcataaggcatgagtgtttaaggagcacactttgggaaatgtggttctactagccttactaggcaaatatgcttctaatatgtataactaacacatgtaaagcactaattatattaataatgccatgagtccttttttctttttctgtctacttctatgatagtttaataccatgctttcttttattatcactaaaaagatggacatgttgaattattttataattttcttttacagttctgtgagttaagctgtatatagcatatgggtgtatcattctttagtaaattacatctacttgtgaactaaacattgatttcattttgactttgtgccattgtctaactttgcaaaaaatcaaaatcaaggaatcaaggtgcttcacaaaaggaacatctatttttttaaaaaaatccattctggtcttggtgttcagtgaactttttttcaccaagctaaagcaaaaacaaacaaaacccccaaataccagacatagaaatggagacctcccttcttcctcaggctagattcctgttagattccaaagaaaattgtgctggaactcagaattttcctggcggctctgcatctccttgctatgcatagtatttc

SEQ ID NO: 2599 - DNA, 940 bp, Homo sapiens
  ref <308>: DATABASE ACCESSION NUMBER: Contig55674
  ref <309>: DATABASE ENTRY DATE: 2001-06-18
atgtataaacaggtaccagttttgattttatttaatcatttcatacattaacatacatgacacatcaaaatgagaaatgcacagtttaaccgttcaacagctggccttacttcaaaagaacactatattcatattaaacatttacagtctttccatctaactttacacatgtcctaaatcattttccagcacttctcacatagaagtctagttttgctctttaaaatcaccatctgtatcacccctagtagacgcgagggtttccccaattacatgctgaagagagccagccaccaccccacctaaagacatccaagcagctccagagcctgcctccgaggccaccccttcgccacggcagtctcgattccaagaactgattatctgacactagtgaaccagcactaaaggctgtaggatgtgactacatcacagttccagaaggaaggggaccatggccaagagaagccctaaatgacagaagctcattaaaaccaagtgccccaaacctcctgaaacatcgttagcaaggagctactgctttcctttcttaaacatgttttgggcatgaccacactctggaagtggtgaactgttacacatttggtgtgtgtgtacataacatcaaaaactactgtgtgaaacttgagaatgtctgattaaagatttcaatgtatatctaaaaactaactcaaatcgttgaccagcactttcccagtatcataacaatgcggctgaccctcttctgccttcactttacaccccatcatagcacattatttgtgcacaactagtgaggtctgtgcggctcatcatccccataaccaagtcggtctgtgttgagtcatatcattctgtgctggttttagaagtcaccataggaaacatgaagtcacatcctggtcaaaaaactgtccatttctcaaaaacagagaaaaac

SEQ ID NO: 2600 - DNA, 788 bp, Homo sapiens
  ref <308>: DATABASE ACCESSION NUMBER: Contig55725
  ref <309>: DATABASE ENTRY DATE: 2001-06-18
caagttagaacaaacattttattattaaaataaacttttgtataaaagcattacagatcaaaagctgtatttacacttatcgattcaaggtccaattatgcatcaaacattgaatggcacagcaatggtttacatatgcaagtaaattggacatacaaacacttagattccacctctaccaaataccttgattaatgcaaagaggagggggaatactgacacaggaaacctgcccagaaactagactggcagagatgtcaggttaacaaactgctaaaagttacatctccaaaaaggcacttatcattgttataaaagtgcttaaaatctaaacttgaaccttgtgcctggtttataaatttacaagaaactgcaaagaaccacagactagtttttaatatcaagtttccatacaaaattgtccaagaatttatttgcaataccttacatgtgaactgaaataaactttgcaaactacaattatactaaagttttatactgaaaattcaaatcagcttactcataatctccagatagctcttccatcattattttaattaagtattacattgcccaccaacctttgaattatgatcgtgtaagctggacgcaccacttacccttcgggcagaagaaattaggagaaattaagtctcaactgtgacaacaacttgtaacataagcgcaatacatgggattgagagacatcaatctgcaataattacctaatttttccacatggttttaagacttttgtgccttgattctattaaaaatttcaactagta

SEQ ID NO: 2601 - DNA, 1505 bp, Homo sapiens
  ref <308>: DATABASE ACCESSION NUMBER: Contig55728
  ref <309>: DATABASE ENTRY DATE: 2001-06-18
ttttatatatacaacaaatttttaattatgtactgaaaataaattacaggaaataactttaaaatgcaacagaggacaaagtcacaataaacattcccattgaattcccttggtgggcggggggggggtgagattgcagtgctcaagataaatatcacaaatatatcaaaaacttcaaattgtctatgcattcacacactgacatgagccacaaacattcctttcacagggacagtacttatttagcctaccacaggaccagattttgccataaactacaaaacttttaatacaaaatcgtatttatatatttataagtcatatacatgccctatctgtgattttagaaaataaaagctacacactgtacagacactcttaactcatagctgtaggcaacatttttggatggaatttcttccccaataaaattaatggcatattttatatacatgaaggctaaactgcaaaaagacagttcagtttcccagatatgcatctccttttagggcaagtttataaatttaaaaaggcaagacaaatgtacacctcagaattactttcttagctacaagagttgccatgtaatttctgtgaagtttctgatacatgcattgatgtaatactggtattgaaggcagtaaagcaatatatacttttaatgtagtggctcaataaaggcttcattgtctttccaatctggttcttgaaacagtgattcataaattctctaaaaattaaaatttcaatgggacactgtgttaaagagactctaaatagatttctgaaaatatttccctgaaatatccttttacataagacaaattcactaacattagattaagtaaaaagaaataaaagagttaaacatggcacaaaggtgcatgattaaccaatgctcctcagtccatctgcatgtcttaggagccattaaaagaatgcttaaaactaacaaacaatcttcacactctgtggcagccatctgtgaagccagttacactaaactacttctacagttgattgtaaactttggtttatttttatttgagttctcattgtacagcaagcatgaaaaaaaaagagagtggagtccgtgaggagatgaactgtcagtctgtctttaatctggcatgatgagacacctggtcagtcaggcctgctttgatagagtttgttacagactgccttatgttttcctccatcaaattatcacccaggggcttcaatacctgttcccatagtgtttcagcaatctgatcaatcactgttccaatttctctgaactccccagagtatttaacatatgcccaagtacaaagaaatatcagtgctaaccccatgacaaggttacacaagacagctatagagtttaggccaatgaagccagtcagtcctgagattatatacatagcaaacatgaccgcaaacagtgtggctggggtacgagcagcatagaagatatttttgccatcattgtgctttataaaatttgcataggtttcttc

SEQ ID NO: 2602 - DNA, 1050 bp, Homo sapiens
  ref <308>: DATABASE ACCESSION NUMBER: Contig55756
  ref <309>: DATABASE ENTRY DATE: 2001-06-18
gagctccaatacatgttttaatctgccttaagtgttttctgtatctagcaagcccaaatcccatccaaacccttgacatgtataggctaacagcctcctatgaccagggctagtggtagaatatataaaattggctcctgggaattagaactagagagcaggggcccacaaatatttcactaaaatgaaatcacccaactcagcacccaacagaaacccacagacccagacatgcacgtgtacaccacaagtcagtagatggagatagcactgtgcactagtctttatgttctcatacagcagctataagcccctgtccctccctgggctccaggctgccagacaagagggccacagtaacgtagaagaagaagagcagctctgtcctcagtcctggagagtctgtgtataagaggagcacgtgaaggtagttacagccgctcaattataatacaggcttaggtaggccacacggttccgatgctttctaaagtctttgtctgtggacagctcagcttttagggttcttttctgtagacatggaacctgagcccagtctggagatccaaatttcattggccaggcaatttttggcggtggcttcttctctgggttgtatgcaccagggctgggatagtaagtgtcctttgggtagttcttaaatcgaggcaccaagacattaaatggagcaaaattttgtttgtgtttttcctgctgaggacttactttctggtacctgcctgcatgaggtgtcatttccttctgtattggcttaaacctcacagctgttctggctcccaaagtatatccttttatactggttgggatcttagataagtcgtatgccaagccatatccatctgaaaaataacacccaggccctctgtggggtgatcccctaagagggacaaacttgttcccaatcaaattcgggggatggaagtgaggaaaaagtttcctctgttgacatgttccaaaagggtagttatccgcagcgtctgctctgctgaagcacatcgcgagctgctagggctagcacttgtgtactgc

SEQ ID NO: 2603 - DNA, 861 bp, Homo sapiens
  ref <308>: DATABASE ACCESSION NUMBER: Contig55769
  ref <309>: DATABASE ENTRY DATE: 2001-06-18
ggggacacactatttttcgttagtttattacaaaactacagatacaatacacaaaattctaattccgaaatccttctacattttttttttctgagactaaatgccctcaaagcccgtctgcttggcctgtattacaacctgactcctcggctcctggatgcacaggtcagatgttccaacaaccctgaccatggccagtgctatggagtcactccaaaggtggttgagccctctgtgaaaatttaaatggctgctaagtcattctaaataaatagtgaacggattgtttctgcccctaagatgaaatcccacagatcttatgctcaagctcaggtcttcctactgccgccttcgacatctagaaagtatggtgggatcttcactgatttgttaaccctgggagtgccccttgtgatccagatgagtcaaaacaaacggccaggatctcttctaaaaagcccatgatggcccttctggctgtgtctccagttggtgcctggatgctgcccatgtgtttaagggccattctgaccatctggtctctttcctgtgggctgtggggtgctccagtgtcatctccctctgctcctgattttaaaaactgtagaatataggactggaccatattcccactcagttcaagggtttctttcatacaagggaggtccgaggcactggccaagctcaagaggtgaatcagtgcctggcagatttgggtccgtaggctgacacagtacttgaattccaaaaagtctatggtgtcttcactcttctgtaaagcggtgaccaatgcattccagatccgagcatactggtcaacagacccgtactgctctctcttccccgggacggaaagggcag

SEQ ID NO: 2604 - DNA, 1302 bp, Homo sapiens
  ref <308>: DATABASE ACCESSION NUMBER: Contig55770
  ref <309>: DATABASE ENTRY DATE: 2001-06-18
ttcgaatataaatttgtttttattgaagcagcagtcacatgaccttatatctagcctttagattaggcctgacagagtgagccagccctaaaaaaatgatgtttctttttgcactaagagacataacatgtttacatacatcatccagtattggaaatgagcagactcaaacacaacatgtgttggttacctgggaggtacagccccactgttcgtggtgtccatatattttacagagacccccaaagaccattactaataggatgaaagttaaaagaaaatacagccacaccaaatcatgaacacagtaatcaaagacagcagcttatacacatttaaaaactgtccctttcagagttgttttctttcttttctaagcagtgtctgcaaagcttcctctacatcaaatccaaaggtttccaaggtggaagctgcacctcttggggctacacaatggaataaaatcattggaaagaacaagaagtggtattgatatcttgttctgtataacaaagattaatgtttccctaattagaggaatggaaatggtgatgtgactacatattgcagcggcaaaatagtagggtgaaggaagagggttgggtattgaaataaagaccacacacttgtgaattttaatttcatttccaggctaacctactttttatttaatgcaaattacagtaccagttaactatttccaaaccaagtcacatagaacaaaatgtatttacaagggaatggggaaagggaaaaaaaacattgagcatacttttcacaaaaaagtttatatttaaaatgaaaaaaaaaatcagtcacagaggcattcaagtagtaataatgttatacagattttgcttttcctttatatcaagacagatttgcacaagtgtttgcaatagtttgtatacaacccacagtcctttatatatatatatatatatatatataataaattttgttttttaggtttgtttttaagatggaagtggtcacgctaattggtatgtgtacaggcccaagtgatccatcggcaacacatttataaatgcaaattttacaggcaagcagattttcatacaactatctgtatctgcctgtagacagatatagttaaggaaaaaaaaacttaaaaattaacacaaggaagtctactttgtcaagctaaccccttatgtactggttgtcattttgcttttattgcagaggtgcaaaacggagcaacaaacttgaataaaacggcataacccttgtgaaaataatccaaaccccagggattactttcaaagcctctggaaggta

SEQ ID NO: 2605 - DNA, 1355 bp, Homo sapiens
  ref <308>: DATABASE ACCESSION NUMBER: Contig55771
  ref <309>: DATABASE ENTRY DATE: 2001-06-18
ctgcctttaggtatggacttgggttggtcctgtcaggaatgatctcagctcactgcacctccaacctcccatgctcaagccatcttcccacctcaacctcccatccattactcactttggttatgaaacactagaaaataatgactgaggcccgacctgacgccaactgaagatgaactgacctcacaaagtgttttcatctctaatatctgtggctatttcttaccaagagagtctcaccctccacacatgggtgagatgacataatggctgatttggtcaaggagcacaaataagacaggccaggcagttactgttcaaacagcaatgtttagttgtacaacacataaagtctagcaacaattacaggaccagtttgagtgtctgtttgcttgttttcaattgggaaatttaactgtaatgtcaccgtaagattggctgggactggtaacatttaagaaacgggttgttcttgcatcccctaggcgtgggcctcttgctccatcaggacttggttgtagatgaatggcccacaagtcaccagcctttgagcaagttgtgtccaggtggagacaggaagagggtgggcaaaggggaattctataaagacacagtgtgtggggcagtggcagtcaacattcgcaaacattcatgcatctgatggggggctttgccctcccttgggtattttccattagcctacagtgaccacctgtggtcaggctaattcattactcacattaatggggaagggggttgggggtaggagtaggtagggtaggtgggaagagatccctcttattgctgagtggacagaagggtgctagtttttccttagcgtgtacatattgtgggtttctgggggtttgtgtgtgtgtttagtttttgtttgtttgtttggacagaagaaagtcaactccagcaatgtcttcttaggaaaaccactcttcctcagtggctgcgttatgaggtggggaggatgtacaaccgcactctgggacagtcacaagtggtgattttttaaaaagtgatcctagcccttgctccccaacatctgtagtgacccaccctcatgaatatctttaagtaatgaaggagacacccttgtcccactttggggctcacacagctgatctcaatgaatctagtaagcagaaaaattgctttcttgaccctttaaggaagccaagagtagctcatgcagatgaatgggtagggagcaatgccattgcccttagagatggttacaagtagctgggatgggcttacaagggcagaaggagctcttgatgagttctttcaccctgcagatgggctaggaccgcgtgacgcagatgatgcagtagggctgtact

SEQ ID NO: 2606 - DNA, 801 bp, Homo sapiens
  ref <308>: DATABASE ACCESSION NUMBER: Contig55801
  ref <309>: DATABASE ENTRY DATE: 2001-06-18
taaaaatgatgaatattttatttttcagacgtccatattttaaatgtaatagttttataaaagaaaaggttggcaacctgttaaggagatcttcatgtgaaaaatacatgtagaagttttaaaaatttgtggatataattgtcattcagaattaagcaggttgattgctgttatctagatgggtctcttcctttatgtttttcagtcacataatcttgatttccatagttatcacatgtacttaaagaagttaatcaatgcctatatggtccaaggtataatttgcacacagtagtttttggtttttatattgtggatcatatgtatcaaaggtaatattcataaagaacaatgttatagttggctacaaagggacaattccacatttctatacagggaatattttaagggtagagttatatcagctatggtgattgagtttaaatatccctgcagggtcaggaacaaaccagctttcccataagtcgttgtgaacactagggaagtcccaaggtttatgtcttccattccagtggagtaatttagcttcctgcagaaaatgctccgaatatctggcatctggattccagcccaggtgccttatgtgccacagggggttaattgtggaatatttcccatgaaacacaatcagcattggggaggtggccacccctcctcccagggagctgctatagaggttttcctccacattcttttgcatccatttctccaattgcttggtgatgcgctggtgcttccattctgtcatgttggcaacaatcacaccaggattgaaagagc

SEQ ID NO: 2607 - DNA, 1027 bp, Homo sapiens
  ref <308>: DATABASE ACCESSION NUMBER: Contig55813
  ref <309>: DATABASE ENTRY DATE: 2001-06-18
gtttgtggtcatgattattattacagtttattacaccctctttgacaacaggtatggtctctgcggtctttagcaagagagcacacaaaacagcatgacttaacttttggtattatgagtagatgagaaattactatgaagataaaagttgaaactatataagcatgaaaagtaaaatttacatgaggaggaaaaaattccttaagttgtatgcacatggttaacgctgacttcacagtgtctcaacaatttgccaaaattataaacttgatgtaatccaagactgaagacagttaataaactgttttgaagaaacatgtacagaagtcttgtttgaataaaaaatacatattagtcacatataatcaaacaactgaaaatgaactgaggcattacattgagctacgaataacaggaaacacttgaaatttcctgatagaggaaagtgctcattctcacatcaaagtcctgggtgaggccagtcactgcacactacagcagaagaacaagctcccctctggttggttttgacagcagcatggtagctatcaggctgaatcaagaatacagtcactactagtatgaacaaaggtgcttactacacaaattagaccgtatgccaattccgtctacagactaggggagtcagagcatcacagaatattcccaaccaggacagtctgaattagttgcctagtacagacataataatgtctgaaggaaaaccaaagtgtggatggatattcaatgcagggcttctggagacctgtgtggaagcctatcacctccgagaaaattaaagtcaagtcgttttgaggatactcttgattggcaacccaaagaagcaggaaaatgggatggaagcaagtgtccatacagcctgtattcacacagctgtctccctgtatggtgcttccaaaccatgactaatgccttcttaacttacttccgaatctcatgtaagataggttactggtgaattgtatcatggaatcacaaatggaatggattctgggaaatctagttc

SEQ ID NO: 2608 - DNA, 1223 bp, Homo sapiens
  ref <308>: DATABASE ACCESSION NUMBER: Contig55829
  ref <309>: DATABASE ENTRY DATE: 2001-06-18
agaacaattcttttatttgaaaactgctggtatgaatttcctccttccctcaattaggccagaaactcatcatggggcatgcacagcatctacaggaggaagccccagcttgtgggggctaggatggagcagccgtgagagacacctagccaaatgtccgtttttccatcataaacaatggagcgggggtcagggggagaagagagtgggtaagtgaatggccagaaactccagagggggcctcacacccacctgtgaggtacctccttgccctacccccactgaggcctcaggccccttgcttgggtcatgctgccccctgtcggctgctgcccctgcctcttcctctgagttctaacaacacagacactggtgcctgaaagccctgctgctgccagggagtcagaattctggctgcctctacttgggaatctcctcccatgtggggatctgcagaacatccagatggggccatcccacctcatgatccattcactcccagtgggatacactggaattcaacccggagactggagcccaacagattaaggcagaattctctttgctctggaggcaggtctgcgggaagggggggaagtctagctgcccctcatgtcccatgccggtgagggtacttggcttcccacagctaagcccaggagcttcctatatcccatctgctgagacagcaaggggtgccgcctggccaggctcctgacatggctccactgaccccctgaaagcccctgcagctcagcctttaagcctccattcatctcggaggtcagatcagccatacgccttcggatgagtgagactgcaggtcactctcacctgtgaaggtgagatccttgaagggaggggcttctggcccatagcacttctgtgctcccaacaaggaggcctgtccctttgacaccctggccaagtacagctccagggtcttgagcagaacccgtgggctcttcttggccaatacttccaactctgcaacagagagaattggggagcagaaggcttgagggggctctgggtgacacaacagtcaaggcctcaagcctagcagctctagggagtacccccaacccctatcccatggagagaaagtgaaggagcctcagatggagagatcaccagagaggtaggctagggagccagctacagccacagggaccacacactctaccttgtctgcacaattgcaactttgaatagtccaacta

SEQ ID NO: 2609 - DNA, 1456 bp, Homo sapiens
  ref <308>: DATABASE ACCESSION NUMBER: Contig55852
  ref <309>: DATABASE ENTRY DATE: 2001-06-18
taaattacaacttacattaaaggcagattctttattggctgaatgtgctgtagtagatatttaaaatatcacaaacattcatgattgcagtttttaaacttagctcacagttgagttagatacaacagttaacatacttaggaaagacaattcttaacagctttatcaagcacatttgtgaaagattaaactttcatttccagttaccatgatgtccccccatacaccaaatgaaccaacacatttatttattttaaataatggaaactgtacatggctacactgtgctctaaaattacttgcattaatgaggacattaattttagcatttaaaaaaagagatttaaaaataaccatagaaaaacttgaaaaccctgacaagccgactacaaagagaattcctctctgaaaattttcagatgcgacggtatgagggagttgggtgggctgctgactctgagagaagtcccggtgacctgaacctattccagtgaagccagtcagcagtgaatgtggggcaagtgcatgcggctggtctacagctcccattgcctggtgaccaaggagcatcctgaagtttcagagaagagactgtgtgacagcagcattgttccagctactgagcaagatccttcagcaggtaagaagtggcagagacagtcacctgctgaaggagcgggcagggagttggccgtccacgcggagcctggcctttccgttaggggaccctgaagtctgcgaccgccccgccaacacctgagagtgtaacacagtgcccgttacacattcacactccatcacagataacacacagggcctcagggactgcaacacgtgcatgtgtagtgacgcacgacaaattaagagtgagtgagaatgaaagctcatgcttagccctgtgaaaaataaaaatcagatagcaaaacgcaaagttaaatcacagacacctggaccacaaataatctaccccagttgtaatatgtattttaatggagaccataaatttttccaaaaacccgcttgaattagaaaacttaaggccatttatatgaaatgagggttttaagcacagctgtacagtttaggacagtaagagctccaaagatgtctacatagctttccaaatctcgtatcagtcagtctctccgtgtgtcgtgggagctgcctgcgcttccgtgaacgggacactgagaaatgcttcaatatgtgccacgccattccagaaaactccctgcagaagcagctcttcctgcagcactcaaccttctgctgagatgcaaaatatattttaaaatgtattttaaagtcatacaggatctgatctagtaagaatggcaaaacaaatacttcctgggcatttcaaatgaggtcattttggttgaaatgtataccaacaattttcgaagtcagaggaagaaaaaagagaaaaatggcaaacccaatgtttaatacacca

SEQ ID NO: 2610 - DNA, 652 bp, Homo sapiens
  ref <308>: DATABASE ACCESSION NUMBER: Contig55883
  ref <309>: DATABASE ENTRY DATE: 2001-06-18
aattttaagtaatttatttcaatagaaatatttcagaaaactgtacttaaattcatcttaagttagcttatgcagacacactgaagatcgcacactcacatttgcatattaaaaagaaacaaaaagtgagagaggaaccaagctgcacatcactcaaggaggtcatagtgcaatcgagtgcttcatcattagagtacctcaagttaattgggataaagaataaaaatggcttgtgttttcagatatattatcatcactgggtacctgtccttacagatgtttgatctccttcagattatgttgtgaaccagttccccaccccctccccacacacatgttctttagtaggatgtaaaacaatgaatttgtcaataatcaaggtacagaaactcttgagagtctgacttattatcagctattttaccatacctattaagtcagtaattattggactatatatgtgagtagttctagtaggtcatatcttcaggggaaacaatatttgttatctggtatctaaagcacagctattatttatgaagtttctgcttttctattaagaaaaaaaagagcccaatcccaaaacactgtaattatgtattcttttaatcccataatcacttctgtagtacaaatggccagggtcaaaatt

SEQ ID NO: 2611 - DNA, 483 bp, Homo sapiens
  ref <308>: DATABASE ACCESSION NUMBER: Contig55920
  ref <309>: DATABASE ENTRY DATE: 2001-06-18
gaggtgtccttatgagtatatttatgtgtcacacacacatgtacacactcaatgctggacgggagggaggttgagacggacaggacaggaggaggcacccaggtggcactggcacaggggaggagaggggacacagcgagtgtgtggccccactttggccccccaccgcctcccaacaggaggtggacctggagctggaagaacaggaaatgcttattctcttagaggacagtttcaaagtgcagaaatttctcttataaaaatcctcttccctccatgctctgccccttgctgaagcccagccccctgcgcaggctgtccgtgaggctggggcaggacaaggtcaaggggaagggcgtaaggccaaagcactggaagggcccagaccacatgggcctaggcatagtggctgccgggcgtcagggggtggtcccctctgtggtccagctggtcctgtaagcgggcaaactccgccagctcgtt

SEQ ID NO: 2612 - DNA, 544 bp, Homo sapiens
  ref <308>: DATABASE ACCESSION NUMBER: Contig55940
  ref <309>: DATABASE ENTRY DATE: 2001-06-18
catattcctgcaaaattcctaagatttattggagactaggcctcttctctggatccacaaccgtgtccagcccagaatcaggacccccaaacgtgtctgggaccctgtccctttcattctggtctagacaagtccccacacgtggccaaaggacagcacccagactctgcccctgaccagtcaatgtgcagcaaacccacttcagtaggcagaagagtctacccctagggagaaggcgccaggagcaggcaggtgggagggaaagtgttcggcagggcagaaaccctgcctggctgtatccaactgtcactcccactggaggcgctgtgtatgcagggcccggcagtaagcccagctgcctacagccaaggcccagcgacagacatcctccttcggtagcagcagcagcctgtcctcctccagccggctcaggaggcctgccacacccagcatcgcccccccccacatcccataagtgttggccgtgaagacagctacaatgaggatggtcactgcgaccaccaacagcattgcctgaccagcc

SEQ ID NO: 2613 - DNA, 840 bp, Homo sapiens
  ref <308>: DATABASE ACCESSION NUMBER: Contig55950
  ref <309>: DATABASE ENTRY DATE: 2001-06-18
tgtgaaaaccaaccaggaacatttattaaaaaactaagcaagttatccccaagagggtgaagcaccgctggctggttctgacattcgattcaggctgaaggcacggcaactcctccagcccttgctgggaaatgtcctacccaggccacgggcagtgccccagtgcagctgggtcccctaaaagcccccaaacacatgatcccaccaaaggcttgaacagagcaacttcatcaagcaggcagggaccacacctgagacacaagggcaaggaggtaaagcacaggggaccgggagtgggccagggacacccagcccccgtctccaactggcgccccctccaggggggctaacatgtggcgtggggccaccaggacctgtgcttgcccctggtggcggaagagctaccctccctcttgggtggtggggggatgttgtctgcacacagctcagacgaccgagggtacaggaagaatcaaactcagtcaaccattcttcaacccaactgggagtctgtgaggcctggcacacaggtgctcaataaacacttgtggcatgaagaagtgaaggaaccgatcttgttcatctctgtgccccagcactcggcatgtagcccatgatcgaaaatgcagactgaacaactgtcacactcttttgtatcactagtgcccggcacacagtcagtgctcttcaggtgtgtgggaaagaagccaatgagtgagaagttcccacaccgtctagcagtgaggaaaaaaagaaaaaagtgaaaagtaccttgtttactcccattcccatcccatagctcagctccctgcacacagcaggtgctcagtaagtgtaccg

SEQ ID NO: 2614 - DNA, 1339 bp, Homo sapiens
  ref <308>: DATABASE ACCESSION NUMBER: Contig55991
  ref <309>: DATABASE ENTRY DATE: 2001-06-18
accaaaatactttctacagaattccaaaccaaaatgtactgtttaaggcatcttttttataacattttctcttcactcaaagatgatagtcatgcagcagtttaatgataaaaatatattaatattttactatacagcagcaagaagttagttgtcaattaaaagcacacaaacatctttaaaggaaaacctgtaaaagactatcgttacaaacaatttcagtttggaggacaccagcttggtaaagtgctctcctaaactttgcattttcataccctacaccttgaatatatgagttatagaacatacttttgatagaaggcttgtacacttggggaacacaaatacacttagcatataatgtagccagtaataactagcaccacagctacatggaaatcctttacatacaccaacttggctttcacttttaaaacaaaactcagaatccatggctcagtaggataactataattgtgttgctctgctttttaacaggtctacataagttaatagcactagcaaaaatcaaagaatagcttcagacctcttacaagtttaggagacagtgctagtgaccacaaatagactcactacctgatgtccaagtacaggttcactggaaattgctgcacgttagttttttaaaatctttctacacataataaaaaaaatatattatgaacgatacaagtacatctcatatacacaataatgacaaaacgcctactcagtcaaagcaaacagatgcagaaaaatattatgggagatctcctttttctttctttttccttttactatttgaataactttggttccaaccataaaaatcacaacttagcaaatttcatttaaatgccttttttaataatttcttcatgttcacagaagtttcactgaccatttttataagtttaaggtccagatgcaatgcatattgtataaaagagagcacttattgtttaccttgcatgaattaaacctacgtacctttaactctacaaacttctgcataacatttagacaaagctcagacacacagcatgcctagccctcatatatatacacatctctaatcacaggtatatagggtgtcaaatatactataataacctccatgtaaggtttgaaatttggtaacaaaatgagaaaaactaaaaatattattttacgtgttctaaaatatctcttttttgtgctaaagtcaaatgttagctcaacatgaaaaggacttttatataattcagcaatattataatcttgaccattttgcaaacactttttaataataatagcttaaacgtgtacaaaagttcttggttaattagggaaataaaca

SEQ ID NO: 2615 - DNA, 507 bp, Homo sapiens
  ref <308>: DATABASE ACCESSION NUMBER: Contig55997
  ref <309>: DATABASE ENTRY DATE: 2001-06-18
cacttatagccaatatttaataatcccatattaactgatgtgtaaaaaatgtctttatgatctgttaccacccaaaagaatgcatcataactttcaagaatatgttctttgacttctaacctctgctcttctttagaattacctttgctgcggccagtacatgctccttgttaatgactctacatttactcgcacaagcgtttgtcctggactcttctgctaatcgatgaacaaacagtaaacagttcagatggaccaataagtcaccacttttctccagacgaagttgaggcttctttcgcttgaagactcgctttagaaagccacggggagccttccgctttatctgcttcctctgggagactatggtcgacagcgccatcctctctgtcaagtaccagctgcctcagcttccgaggtgctctctgtatcgcacacaagctccggggacactgggccagcgaaaacaatccggtccgtatgacgcttcttcaggcagaaaaacct

SEQ ID NO: 2616 - DNA, 630 bp, Homo sapiens
  ref <308>: DATABASE ACCESSION NUMBER: Contig56023
  ref <309>: DATABASE ENTRY DATE: 2001-06-18
tcaaaacatcagactttactgattaaaaactcagattctcactaaaacacacacatgaaaatatctgaacaagacaaagaagagaaccctcttacaaaatcacaaataaatggtggatagcatgtctgttatgtgtcctccattgacctcctttcctatgtccattatctattcatgaatccttccatccatgaggtacttttttttttgtaaatgacaatcccccttcatacactcttgcagcagacattctttcctatctacatccccagttgtttcatatatgaacttcaatcctgacccctgcccatgaatgaacagaacacccatttcaagaaattgggggttttcaagaatatatcattcactttgacaggagagagaaatacaaacagtgagacatgtccagaggccaaattagaaaaccacctgtgattagttgctgaattctgagtcctcagattctccacatctatcaagtggtttccctaaacttaatctcatgtttcccaagacattagtattcttcaaggttttctttctgaagattcttttagaatgacatggaaaaatattggagaatctgcacatttataagcacaagtataggtaacctttataaattatctg

SEQ ID NO: 2617 - DNA, 907 bp, Homo sapiens
  ref <308>: DATABASE ACCESSION NUMBER: Contig56030
  ref <309>: DATABASE ENTRY DATE: 2001-06-18
gtattttccttcactttaatttttattgcttctccagttcagataattcagcgcttcctctttcttcttcctcaccttgttcatggctggctgttccatcagcagaacttccagcgattgccacattcattgcataagacaaaggtagtcatgggctcatcagcactgcgtgtctgcacctggttataggtgcagttcttcttcttgcatttgctgcactggaagaggtcagtggtggtgccgccagtcttggccatctggtgctcacggatggcctcctgggtcatggcattcctcaactccctcagttcatcactggccatttcctctgccgtcatcttggctataagccctgcggagatggccccactgagcacgttccgccgcaggccggggttcctggggtccttgaggttgcttatgcggctgcgcacgcggttccggtacttcatgtccgtgctcttgagctcttggtagatatgatcttcgatttctgatgccatcttgtcacagttgactccatagtccttgtaatcatcgtccgccttcagggctgctgacagcatctccacacacttgtcccggacagagtcccctgtgagatagcagggggccaggagacacatggaagaggcaaacgtgggggtcaaggggctgctaggtgttttggggctctccgcttttgatttgctgctgtttgatctttccaccgatggtctttttggagaggaggaggcagaagacttggagtccacagagtctctcctggttttggggtcttctcgtttttttccttggtggagaaaggcctgcttctggcttccagtctgaacactcaagccctttttccttcttctttgccttttctctttcctctcctttttctccttttgggggtccaggggag

SEQ ID NO: 2618 - DNA, 1098 bp, Homo sapiens
  ref <308>: DATABASE ACCESSION NUMBER: Contig56093
  ref <309>: DATABASE ENTRY DATE: 2001-06-18
actttacgcatttttaataacaatggtacccaattcattaacaaatgaatttaggcaatgtgctttgctctacaatccatcagatacattttcactgcagatagttcagaaatcattttggaaatagacacaaacatgtacatattcatttgctgaaaatgccacttacagctttaatatcaaatatagttatcatagttcacagaaaaagtataaagtgcaaaagctccacttcaaaaggccttaagtcactcccaaagcaatgaggattaaattttaccacagccagtgggcatgccacccttatgtaggacacctacataaggtataaaacaaggtatatatctgaaaacactatattgctctgattacatattgtggttataaaatagttttaaatctggtttaacatacagagaaagatacaattcaaacaattagtcctataaagtaggggttatttatttttttaagtttgcaggggaattatgtctataaaatccattgagaatcccaatctggcccaagacttctctttggccagctggaataatagcacctaggcaaagccttggctatgaaagctttcagattaatttcagtgtaaaaggagctaggagaggggccctgactgggtgagcttcagcatccacctggtccctcagagatggttccatgtctgccccaagggataaagagccaggaaggctcaaatcccagtcctgagggctcatggaagcatgatgaactggcgagagaagttttacacacctgacagatccagtaagtggaataggtggtcgtatttttacaaagccttgtgtttgatgaccatcaagctttgtccctcaacagaacatctttgatctataattaatgttttaggcactcttcactggacaggcatagagttccccaaaaatgcagcccatccccaaatggattcagacatctcatctccacacaccttaaatgtgttcatggaaggacttgatttataatgatgtaatcataaagggaagaaaatattactttttctaataatcaacaactaaacactgtaaaacatgaatcgctgactgaaatgatcactcggaa

SEQ ID NO: 2619 - DNA, 801 bp, Homo sapiens
  ref <308>: DATABASE ACCESSION NUMBER: Contig56143
  ref <309>: DATABASE ENTRY DATE: 2001-06-18
atctttaacaaaggtgtgtttatttccatatattgctcattacatttttcttgccacagttttatctaaagccaggtcaaaatctttctctaaggtatttattaatagtgtatgttcttcagatataaaatccctctggtcaacatgcaacatttgaatatctattggcactgtacctctatgagatatttatgacatttgttaatagtgaacctcaacctcctgaccccacatccgaagttgggggcgatgtgggggaacatacacaaaattacaaccacattactggtcaagcactttatagctaaaatctattgactttaaaatagcattgtatgtgaattcagagttttaatgtattttgtggatcaaaaggaaagggtcaaaggctaagctgaacacggagggcactaaattagctaataaggcagctagtgcccctgttcttgccccagccctgtcatatcactacatccgattctctcaaatgttataaagaataatgaacttaaaacttcaggggttcctgaaaactggtattaaattaaaagcagagtagtcaaaattctttgcaaatgacttctgtgatagaaaaaaatatttccaacctgcgtcagaggagaattatcttttaggtgccaaggaaagagtgataaagatgctgagtatattagtcaaggtcatctgagaagactattttgtggttgattcttctgagcccctgaattgtccaacattattggtgtacctgtagcgtgaacaacattgcaaccaataattttttgaatacagcaatgtaaa

SEQ ID NO: 2620 - DNA, 773 bp, Homo sapiens
  ref <308>: DATABASE ACCESSION NUMBER: Contig56160
  ref <309>: DATABASE ENTRY DATE: 2001-06-18
tgctttccagcttttatgaaaattaataacattaatagctcacagacatatacatacacacacattgctatgtacacagtcattaagttattaattaggctctgtaaaaaaaaaggtttctacattagtgttccgggctaggcccgatcagtccttggcatattcacagtggcagccccagggcttggccccacaggcaggcagaggggaggcaggaggccacagagcagccggccccacagtgagcacagcaagtgtcctgggccacctccttgagtcttcagttcccttcctagcacctgcagtccagctgctcagcaagccggcagacaggtcctgatcccttctgtggccttctgcatggtggcttcgggcaacgtggcgggccctagaggatgctagccagctctgtggagtctgtttctgagcagccagagctgctggcctcgtccctcagtgcctgcagggccttcttattctgccgccgcctctcctcatcaatggggtacattttgaagagcagcaggcccagcaggatgagaactatgggagccatggtcacgagcatgttcagtgtaaacttgacacgttccgctgcgagcagccacgggtctggtaccctgcaaagtccagactgagggtagaaatgcccagtgacactccagaggcaaacttggtgaagaagacatagaaggagaagaagatgggctcggttccatggaagtggggctgcttcagatggaagtcgtcaatgacatcaggcagcatggacc

SEQ ID NO: 2621 - DNA, 668 bp, Homo sapiens
  ref <308>: DATABASE ACCESSION NUMBER: Contig56205
  ref <309>: DATABASE ENTRY DATE: 2001-06-18
gtgtatgtgtgcctgtgtgctctttcaacaaatttattcaattcacagtgatatctgttggacagagtcagcaatcctaccagacaaaactcatacacacattgattccagatgagaaacaacagtcccccaaggagcttgagaaatcacctagggcagccaagctggggaagggaagtggctgtgcattgctgtgtgtcctttaaggctctttggtcctggttgatttcctcttagaaggttccaaataaaacttccctttcctattcagtacacaccagtctttctttggtgtttaacctaatgggctgaggaagggaggcagccaggaaattatacccattaaagtgtgtggttaatgcctatatatatcatttttactcacagttagtggacttatcttttaaaacagaggtatgtggcagtggggtaagagaacttcccttattatagagaagattccaagaataggttcagacatgatttgaagaaccatgtaactctgctgccttgcacggtcccctttttagcactaataactcctaagtgtctgataatttcaaggttagcagcactcccaaagaagctgtccgggctgggtgtggtggctcatgcctgtaatcccagcaatttcagaggctgaggcgggcggatcacctgaggtcagg

SEQ ID NO: 2622 - DNA, 1760 bp, Homo sapiens
  ref <308>: DATABASE ACCESSION NUMBER: Contig56270
  ref <309>: DATABASE ENTRY DATE: 2001-06-18
ttgttgttggaaaaacatttattgcaattcagtgtcaaaagttttttacaaaaatatgccaccgtctggtacaaacaactataaaaaatcagttcatcatgcaagaaaagtgtgcaaataatttatacagaaggactcagctcacacaatattaaataaacatctctgcatgtaattggtctaactttatgctttagttacaatgttcaaccccctctaatacttttcatttaaaaaagtacattaaagcttctaagcttaggacacaggctgtaatatacgcccactttagccatggtgattggcacttggtagaataaagatggcaccaaggattcccaagtatagaatacagcttggagccttctgcttaacagacttgtgcttcgttaattaaacaaacacatctatactcaaagacagaaaaagtcatgtttaaactccagaaataatgtagcagatggagttttaagaagttcagagttttggagcagccatcatttttggccaaatggagcagggcctaagttttgagagattctccagaaagctttgtttgctgagtgaattcaaggacactttgaaaaatgcccagcagacaaagtcatgaatatcatggccccttgctcctggctgcctcatggaataatccccctttgcttagtaaaagatgaagtttagtggagaatgaacatccgctgggctagaaatgcactgaatctcatagctggtcctgaaggaggaaatggagaagatggattaaatgtacctctgagtctaggggagaggaaacacctgcttcggaatctcagtttctagggagcaagccactgcccagcccttctgtctttttttataacggccatttttgtaataaaaatgtaagtacccaaggaagaaataaaattgtcaaaatatgctgctttctttatagcaagcaggttgtactcactggaatgccacattcacaacagaatcagaggtctgtgaaaacattaagtggctccttaacttctccagtaagaatcagggacttgaaatggaaacgttaacagccacatgcccaatgctgggcagtctcccatgccttccacagtgaagggcttgagaaaaatcacatccaatgtcatgtgtttccagccacaccaaaaggtgcttggggtggagggctgggggcatagaaggtcaggcctcaggaggcctcaagttcgcattcagctttgccactgtaccaggtgggctgacgcacatcccctaaacattctggatctcttactcatcgtgaaaggcagacgctctaagtctaaagtctagggtaggagtttccattctttggaaaaccaaagatggttactcttcttaatgaaactgagaagaaggtatctacagaaaacactgaatttaaacaaattatgaccttgtttgttgaagccatcaaggacccaagatatatcaaagaacaacatctctgtattggcctacaggttcagagtgttttgaggtctgtttaagcactaataggattttaggccagcatccagtcagaagagatagttcacagactcagagttggaaacagattaaaaaaaaaaaaaagatgtcaacatagaaaatgatgatagagtttagttaaaaaaattcacacataaaattacagttaaaaaaattcacacataaaatagagtgtttgcatagcaagacattattgcccttcagcctggcagaaaaacataaactcaggtgtatattttataataaac

SEQ ID NO: 2623 - DNA, 1214 bp, Homo sapiens
  ref <308>: DATABASE ACCESSION NUMBER: Contig56276
  ref <309>: DATABASE ENTRY DATE: 2001-06-18
tttcctataaaattttatttattacataaaaaattctatacatttgttagactaaaatacagttttcattataattctggcaactgagtcagtacacagagaaaacttagcattagatcagcacttttctttctagttcgtatttctgcacaagaaaaacatttcaaagctccgtttcatataggctgattgttctctgaagccagatggaattccatccaattcagagctcttggaagttaatttcccagcaagatttgataactccaactccagaaagttaattgcttaatatacatatttttaaagtcctctgagagcataatgctccatctgcaaagtctgcactgtgtcaataatgaccgtcacaaatactagggctacaactgtgtctgtggggcatgttcaagcacctacatgtttgttcccccacatgaatacagtgtagtgacactgtaataagaaaaaaatccaaaataatggtaaggtaaatgattccaaactatgaattcatggaaggcttaactgtgatcctccagtttataatggacaaagacaagacaagatacaaaaattcattttggcactatgaaataggatgcaaatggcaaaaaaaaaaaaagacaaaaaggcatcagattgagaaatatgtggcaccaaaacatacttctcatgccacattacacagctgcgagaaatcaagacacaccgatgtgtgttttctgctcatatcaccccatatgctgggctgggcttgacactggatgtgaagactcagtgcctgagagatcaatagcaggtccctactgtattgactgatctttaaatttggccgccttattattctaggagctctattctaaactcaaggagttcagaaagctgtgccagccagtaagtaaagttggacctttggtcttcagaagatagggttttgtctttggttgttttttgaagcccctgtcattttgcttgatgcccttcacacttttctccctgcctttttgttaaagtttttttctcctgtaataaaatcagttaataaccactgaactaacttctttagattaaagctctattagaagtgcattcagtggtccagaatattctgagaaagtataacaacttctttcattatggagctctcagtatctttttatagggaagaagtcagaaaactccaacaacacaacacaatctagtagcattaaggc

SEQ ID NO: 2624 - DNA, 824 bp, Homo sapiens
  ref <308>: DATABASE ACCESSION NUMBER: Contig56291
  ref <309>: DATABASE ENTRY DATE: 2001-06-18
aagttctcagcacccattgtaatttatttgtgaatgaatgggaaaagggtatcagtccaaggggagatcaggtggttcctcctcatcagagtcaaactcaacattttcatcttttacccatcgacctcgtccatctgggatccatccagagcttcgaagggtgagataatggtccagggctcgtcttcttgtggggctcatgggtgcaggggctgagacagttgctgactcctcggcctgtgggccagccgcaggttcaggttccctactgatcttcccactttggagtttgacctctgagggtggcataggggaaagggagacagagggaccaggggcttctggtctgtacttccggcggcagcaactgttatagtggggagctctgtgcagagcactctgggtgataagtcgtgtctgagttagcagaggagcctcagctttggtttcttcccttctcaattcattctgatgttttggattctgctttctttcctttcccggctgcttcttgccatagaaaagctgcaagctggacagatgtttcttgcctgcacggtgggcagtcagcatggccagggtgtccagtaccggtcgatgggggcagatggcacaagcaaagcgtccatcccgaagcatcagcgcctcatcctctggaatgtaactggctaggaggtccccgactcttctttttttgagcacattgagttgactccaatcgtctccttccctcttgaaagacatcacgactgtgagtcccagaagtgataaattctctgttccggtttcgccactcctccaggccaccgtagcaagagcgggac

SEQ ID NO: 2625 - DNA, 844 bp, Homo sapiens
  ref <308>: DATABASE ACCESSION NUMBER: Contig56298
  ref <309>: DATABASE ENTRY DATE: 2001-06-18
tcaaaataaaaaatgcaatttttatttgttgaacataatttgaaactgtaaaaagatttctctgtccatcaccagaaatccagaagacacctgaagaggactgactgtttctttgccacggggaaggtgtgatgaaacaattaaaatcccatgcatccctggcccttcctccacgttgcccctcagaatgcctgcagctgcagcaggcaggaggcagcaggagaacccgggctgtggaaggcccctctgcctctctgggaaagctgctggggaagccagaggtcacagtgcattggaggcctggctttcagccactggccaggccaaaatgaaacatctgctcaagtctccccaggcaccttgctgggggtgagtgggagaaagaagtggagaaaactgatgctggaccacaagttatcaccctgtaccttggctttgaagtggcccctgctggtacaggagcagggtgagagtaaaagtaaataaataaaagcaacatgcttcaaggagagagggtgacagacccactgaagcaccccgtgtcctggctcgaccagggataagccagggcgtgatgatttaaaacactctgatctgaggccaatggcatcaaaatacaaattgctgaagtgggagaggaagtgaagggctgtttgttagggggactacagtggagattctggtgagtgtgggtgggctcgccagtgaccccaatattttctttgtgtaacaaccagagtaagcattaggatgcccaggctgccctctactggcagtttctgggaaggaccacaacagcagcacccaacctgcaacccacaacagccgagacaggagagagaga

SEQ ID NO: 2626 - DNA, 1440 bp, Homo sapiens
  ref <308>: DATABASE ACCESSION NUMBER: Contig56303
  ref <309>: DATABASE ENTRY DATE: 2001-06-18
gccaataaaatattgcaacctttatttaaaacagaacacaacttggcaaaccttgtgagaagacagagaaagcagtccctttcaagggcctcatttatttacatcaagtttaacactgttagcagttcacagtcagacaacagacggagagaattaaattagaaaaacaactgaaaatatattacaataacaattaagaacaaatacctgacaacactggtaatgtgacacacaattgatgtgtttttagttaaatcccacattgtctcactatgtccccttagcaatgcacacagtgcccgatgctccaaacctcaccctctgtgcaccacatacacacctgcggggcgggacctttggtataaacgttcaacgagttttaaggaattgaatccgcatgtttggggacaaagttctgtcaaccaccatgaaatgtttaaacttatttttactaagcgagcataaaactggggtttgtccagtgacagtcattagagaatcagactgcagagaaggaaaagtgcagggtctgggaggagatggaggttctgagtatacatcaacagctaagtcagcctgttcacagtcaacacaccaaccacgccactgctgttcatccaaggaaagatctgagcgattcctcttttacttactccccctttcttaatgggcacgacagcaatgcacgtgtatttatggacacaaacacacaccagctatacagatctgagatgagagggttttcaaacatatgccctaaagaaccataaacaagtatctcattgttcctttctagtttctgaatactgattgacaattggcctaatcatggtgatttctcaagatctcaagaaattcctctcaaaacataatggagccaaatggccacagtgagaaattgctgtcaaaatggaggagagctggtttctctggccctcatctaccagaagcatctctgtcccctggcgttcttgccactcacaatacctggtatggtacttctgaactgtgcagaacagtatctgaggtttactgttgatgacactaaagcgttcccagtcctgcaaaaccttctgaaacaacaataaatttgcatattctttttattgtgtcataattgctgaaaattaagtatacatatatgtgaaaatttaagtcccattctccaactaaagtttatggtgcctaattccgaagcaaatttaagcaagttctgactacacaaactccttatgtttcctttcataaagcctgctagcattcgacagtttgcctccagcttttctaaaaggttacttagcatgctcggagacctcagcttctgagggttcagctcagtagcctggagtgacaggtaggaccctgaaaatttgctgatgcgagtacagtgatgaacaaagaaccttccagaatagacacagatgacatgtatcacaattc

SEQ ID NO: 2627 - DNA, 1491 bp, Homo sapiens
  ref <308>: DATABASE ACCESSION NUMBER: Contig56307
  ref <309>: DATABASE ENTRY DATE: 2001-06-18
cgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgcaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttcccttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcccaatcattttgaatccctcttcctcccttttttttttaagaaaataaacattttactgtttttatgg

SEQ ID NO: 2628 - DNA, 1096 bp, Homo sapiens
  ref <308>: DATABASE ACCESSION NUMBER: Contig56390
  ref <309>: DATABASE ENTRY DATE: 2001-06-18
gtagttgctgaaaagaagtttattgctattttcttattttattatacaaaactagatttgcttaaaacatttcccagtctctttaaaggaatgctagttagtgggaggccacagctagtaaattaccctcagtagtggtttcaagtagtccataactataaaaatcgttacggccaggatatgccggaacagaacactccccactggggtcctcagccttggatgtcagctcggcccctcaaggggtccctacacctggaagctgattccactcatcagtctcgagctgggcgcatgtggagttgatgtggagttgtagctgactggctggtggggtcagcctggcctcccagtgtggagcatgggcaccagcctcactgcgtggtcaccctagggcatatgctgcgggctgttgtggcattcctgtggccagcccagaggcaggcaggggctgtctggggtttgccatgtgcaccatcacctgggcttggggtgagctggaggagccactgaggcttagagctctggggatcccagggtccttgtccacgctgcgggtcacactggccagcttgctggtgctctcaccatggtctgtggtgaagctgtggttgtcgtgcgcctggctgggcccgctcacgggtttgttgaagtgcttgaggccaaggtatgcggcctgcaccgtctccaagtcctcatctttcagctgggaccacagctgggctgacctgttggagcgccgccgcttgctcttcttcacgcacttgaggaggcagcaggtgaggaaggccatggacatgagcaggatgatggcacagctcacaatggaggcgatcacggccaccttgaagccaaaggtctcgtgtggtggcaccagtttgcacactggggaccctgaagaccactcagcgatgctccccttccaggtgcaggtgaggagcccagaccccaccatctggtggttggaggggcagcggaacatgagcacggtccccacggaagcaccattgccacgaaggacttggaaggttgcttgcgggggtagccgcagcttagcgcaggtgcctgtgcggttccctggggcaggcgtggtgac

SEQ ID NO: 2629 - DNA, 2121 bp, Homo sapiens
  ref <308>: DATABASE ACCESSION NUMBER: Contig56434
  ref <309>: DATABASE ENTRY DATE: 2001-06-18
ttgctcaggtaataatttattaagtcaatttaaactaaacattactaccattgcaaaagcatttgctctgaaaagggactgaaaaatgcatcataaagttacatagttcagcaacaatatcaatattgattatataaagtaaaactactggcaaacgtcatttaagcttaccctgtaatttttaataactttataaggagcaaatgtgtcaccttaaaaatgtaccagtggcatttacaaattccttcaaactcatttacaaatacagtaataaaaattcctgagctcccttttcttacaccagtattcaccaatcaacatccatgcggtgttttatttgacccacatcctctttccttttcttaagaaaatattttatcacattcgtaaaagtatctgtgcttcaagtcagtttgtaagtatctgtttttaatgtgaacctgatgataacaagagaaaaatgcttaacattagcaggggcagcaggaattgaggggtggtgtgggggacagtggaggagatgtaaatacaagaattccagtttaggtgttgggacttccaaggtagaatacatctgacaatatcaaaaacagactcagtttcatctgcatagtttcgagggactttcaaaggtgaagccagcaggaattactctgcatattctggccaggaaggtccctggtgggggcttttcaataattctatttcttatccttctccctagtccccccactgctcccttaccccaagatttcaaagtttctattaaatggaagttgcatcttccagccccaaagaaactggggagatttagaatgtataaaacttgattagcaagttgtaggaaacctgacaaagttaaggtgtcagatgggattctggcaagatgtggcaatatttaatttctgttttctttccggaaagtatattcaatgcttttgaaaaattagctacatattacttctccagctcatcattaattgtatagaacctgtgtctggtgactgagacttcaaattttgcaccttaaaaatataagagggcccaagaattaaaggcagttggcttcaatataagcacaggagagccagcgtttctgtgactgaagccaagttttttagagcatgatactcaagtaagaaagaaatttctcattcttctgtaagacatggaattagagaattaagaggaggcagagaagaacttggaaagcaaaaccacacaccatttcacaattctggaacacggacatgaacagtaagtgaaactttctaggtttagatccattaaaagattatccatttacacttcatctgatggattttgtcagaaaagatgttgttaataatatggataaataataactgttcaaaaggattccccacttaaaaaaatgctttggttcttcctttatttcacaatatttaaataagcttctcttattggatctccttgtatctggttccatctcccctcatttttctcagcctcccatgttatagggatgaggtaaaggagggaaattttgtcttgcaatcataggaagggtggacataaaggggaagaattttttttgtccaacttacataaacaatgtcctgattatagatcttttggtaacaagaaatgtccaaaaaattgcttcagccatgaatgtgttattttgctcatctccatttcaaataaaaaaatagagcaagagtaggtaagggaattaaacatttattaagccaggcactgagctgggtattttcaataatgatgtgaatagaaatataactaacatattatattgggatgtctaagattttgtttggcaggcattggttttggcatgcagtaaaaatgaagatgttatgataatagcagttagtgttatctccaatactattgacaaagatttaactacccatgttgtcccctcaaaataggaggagataaatgaataaaaccatggaaaacagagagcacaatgtgccataagcaaagatttacagaatgaaaaatgcaaaataacaaatcagataactatagtcttctataaatctttaagtctaaaaaaatagacattacaataactacatatagaaatgagtttttaaaatcaaaataagataattt

SEQ ID NO: 2630 - DNA, 1165 bp, Homo sapiens
  ref <308>: DATABASE ACCESSION NUMBER: Contig56457
  ref <309>: DATABASE ENTRY DATE: 2001-06-18
gcaagtcttttttttttttttaataaaaccaacataacagaatgtagaaatctaaacgaacatttctccctcaaagtagttacatccttagctccaacaaaactactattgttggagacttatttagaactcctgtttgaggaaaggccttaaaaggtggtttatgagccacattagaaaatacccttctaaactttgggctgtttaaaaacagaaaatccatactcagaggatgacaccgagaaaattaaaaaggtgctgcagctctcacggaggttccctaaagacctctagcaagttctgagcaacagcatcaccattggagaaacgtgtagcctcccaggacagccactttccatgggacggcattcatttggatagaaaagttctgctgtctgtttaaaaagaaaaaagaaaaaaaaaaaatcagccacactcctttatagtcacacttgcatttgattaaaaaaaaaaacaacaacaacaacactcacacgtggttcttgtatgaattctaattaagagacattatattcagaattatagcactcatagtgataattttcagaagactataacagcttctttgccacttaaggggtacagagggtgcagctgtttacctgaatgaattcttaaataagtgactactaccactctaattttcctagttgtagctctgttacaggttactgaccgccaagtccatgttccagacattctttgccaacacagattaattacaagagagccacccccaaagtcttagggcgaattgggaaagggccggttaaatgaggaaacaggccattccttggtaaaagtttgtagttttctttcccaatacatcttctttttattgagaacttccatttttatcctgtgttcctcctctgccatctcacactctcgctctatctgctggattttggccacatgcacctcattcatttgtatcagttgcagttgtaagatggacatttgttgatggtgttcttcctcatgcatcttttttaaagcaccttcctgagaggttttgctcctgtagtttttattggctgttattctgacagctgaacacgagggttcaggttgagaggtcccctcacatactggaaaatgtatgaactctttctcatcatcgcacagttctctatttgaaaca

SEQ ID NO: 2631 - DNA, 695 bp, Homo sapiens
  ref <308>: DATABASE ACCESSION NUMBER: Contig56534
  ref <309>: DATABASE ENTRY DATE: 2001-06-18
tcacctgggtggccgtggcgctgctcgggggcgccttttacgagtgcgcggccaccgggagcgcggccttcgcgcagcgcctgtgcctcggccgcaaccgcagctgcgccgcggagctgccgctggtgccgtgcaaccaggccaaggcgtcggacgtgcaggacctcctgaaggatctgaaggctcagtcgcaggtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattggtattttttgagtgc

SEQ ID NO: 2632 - DNA, 1298 bp, Homo sapiens
  ref <308>: DATABASE ACCESSION NUMBER: Contig56670
  ref <309>: DATABASE ENTRY DATE: 2001-06-18
taactatttaattcactcctttattctgggatgtatattacagataacacaactcacaaatataccatcagacattgaaaactaaggccattctgtgagttatttttaaaacttggtgttttgcacataatgatcttaaaaaaaaatgaattaccaaaaccaagattctcttctaaaatgaaaatttaatgcaggtacaggataactttagggctatatctaatctgaagcttatcaggtagcaaaaccattttcgttttctacagcataaataacagctctaaggcaaccactacctcagcatgaagctcatttctccacgttagagtagtgtttacctgctacagtgaccagtgtttagagaccatttccctttcagtagcaaaaagagactttacctaagaaacacactacatactacagaatccttggaacaagaaacagaaagggagctgtaactaaggcactgaaagcacattatttgtataaagaaatgtaaacaatttaacaccaacaggctccctccgttggagtctttattgtaaatgcacacaggggcatcatagtcagggctagagtttgaagtctgggtgaaacaaatgtttctgcagagttcagagtcttggctgccaatatatttctaacatggtgctgttgaattaactatttcaaagtgactcaagtggaagctggtatttcccttgaatctgagttttaatagcattaacaaacaaggaagaattttataggagtcctaaaattacgggctctttctaacatttatttgagtcttttatcaagttcttctaatgaattttaggattattttggcttatttcatcaaggaagtttggtgtaagaacttgttacctaatgagtgcccctccttgtaagttcatatttcaagttacatggttcatgccataaataaaccacacttgctttaacatcgttcagaatggtacatttaacaattggacatacagcactgtaaacaattcaaagtccattgagcttaccatgaaagaactgaaacgtatgtaggaactgtgtcctgctgcagacaagcagctgctctggctctggtgcggtgcggtgcggtgcggtgcggtgcggtgaggtgaggtgaggtgaggtgggcaggtgtggaagggagaattcctgaggccagtcacaattattgaagctaaattaatttcttcctgacactttagcattaattctaagtagttctaagttctaaaccattaactgtataatttttttaaatcaaagaagaaaaaggctttcacacagat

SEQ ID NO: 2633 - DNA, 976 bp, Homo sapiens
  ref <308>: DATABASE ACCESSION NUMBER: Contig56678
  ref <309>: DATABASE ENTRY DATE: 2001-06-18
tttcaaccagtttattgtctgactcttctttttagagggcgctatttgcaggagaacagaacgcgaataaggccagagaaagcacacgcttgtcaacaaagcagatatttcaaccggtttattgtatctttacaataataaaaataaattagtcacacacaaaaatagtcatttttgctgaagagaaaacagaccatatttactcacataattcgccttctacctttcacctgcttatgtaataatttaacactgtagaggggacatggaggtgacggagtatttagtgggttccttgctcctggctgtgcagttcacaggccccacaggccttggccccagcatccccagcagggacagtggaagtgtcagagcagtaaatgccaccacttccctctcagcctctccctgtccccgccagccacctgcctcacccacggctctaaccaagcccaccgagcaactgacgctgccagtctaacaacggggacaaagcaaagagaaagggataacagacaccctcccatttccttctccaaatgtctgtggatgaggggaaggcagattagatgaggaaatataatatttaagatgaaaaagtagcaatcaggttcaggtacaatgctacctgaatgagtcgaaaagcagagtaatttatatttgatcttaaacctcagggaactggactgattagcatactaaacaattgtaactatggactgagaaaaagacatcaatcatcgtacagcgacattccaggaggctgggttagtatgatcacatgctttcacacaaatgtggatcgcatatgtaaataaatacctatcaggtccctttaaaattaacacattctaaataatagaactattttggtgtagtgactcattctgcagatagagttcagaatacatatttcctataaacatcttgtatttacagagaacaaaataataagttataacaaagtatatccttc

SEQ ID NO: 2634 - DNA, 488 bp, Homo sapiens
  ref <308>: DATABASE ACCESSION NUMBER: Contig56742
  ref <309>: DATABASE ENTRY DATE: 2001-06-18
ttaaaaaacaaagaacactttattcccttgacagtttctgtacagcgacaccaggctgtgcaaagcccagtgtcgtcttcactgagcacattccccaggacgcctggtgcagccctcctctgccccaggccccaactagccacccctgtgcccactagcaggccctgtgccttcacagggatgaagccctggcactgagaatgcctgggaggcaccgtttgctggggagcagagggactgacctttggcttctttgtggctggaggtgttccaggcctggtgagggggtcccatactgttctctgctgagccctctgcacactttgggggatcctggctggcggtggtaggtgggccggagactcagttgtccgtcagctggccatgtccccattttatggacaggcagcctgaggcccagaggcggaaggatttctccttgccacagctgcatcacacttgaactgtccagacctccaccgctggcc

SEQ ID NO: 2635 - DNA, 1463 bp, Homo sapiens
  ref <308>: DATABASE ACCESSION NUMBER: Contig56759
  ref <309>: DATABASE ENTRY DATE: 2001-06-18
aatttccgaatttattaaaatgattaacctcaatactgcaagtgcatgtacaaaatatttgtaaaaaatgtttttaatgaaacgttaaagaacttacctcaaatgctgaaaaagtcctttttcattctttcagtacaaggaatacattgtatctcaaaagtattacaactcagcaaaaacaatttataacagtaatttgaaaatgattgaaaattgaatactttacatatatttctatgatcatctcctaattcttacaatgccaaaatcttaaccaatcattgcataagctcaagctaagagttttattgaatgcaacctcttctaaactggtcaacggtgtgtggctgtcaccattccacacggtgaagttctacagcagatccggaacagttccgaggcccctacctttaccaacggaaattaggtttccctagaaggcatcaacagtggctgctgagtgcttgtgcataccgactcctgagaggcagtgatttactaccaaatgtcactgctttgagacccatgggaaggttggcctccaaagaggaggccatgataaaattaaaacatcaaaaataagttactaaaattcagctgaaaaatgaaaatgggaaatgtgttttgtcactttttaagatcgaaattcccaaaatagctatcgttggtattcaaataaggtttaagatttagtctctgaacctcttcaaaacaccccaaactaaggtgggaatacaagaggtgacccgctgccctccagcacctccagacacagggtctaccttcatcttcctcagtggcaggggttcacatttctatgcagggaccccatgagggctggacgtgctctgcaaagtgctccgggtgcctcggacaggtgctcctgagaggctgtgtgggctgccctacttcactgttgaagacctccagacgcagtgaacgggggtatgggtgggtgtggaagaaggtctaccacatgctttccaaacgcctgaggagttcgactgcaccacaacaaacaaggatgagactatgtaagactgcagaagtagttccttagagaaccaggagaaaacaatctactttctaaaaatgttcatgagtcttaatttctatttggaacctatgggcaatcaacagtcttaaggagcgtcattgaaacaatatccccccaaacctggaaactagtaggaatcaattagtagtaacagtaagcattgagattttctccactggacttttcatgaccttcagattccttttcatatttcaagacatgggctactttcctatagacactatacaaatcccctgaattgatttttacttaggaacactgtatatcagaaagtacaggtacacatttcccagaaataaagagacctactggtgtcaaacacctgttacagatttatattcccaaattctctgtccaatgatttgcaaaataatccagagaaatg

SEQ ID NO: 2636 - DNA, 1124 bp, Homo sapiens
  ref <308>: DATABASE ACCESSION NUMBER: Contig56765
  ref <309>: DATABASE ENTRY DATE: 2001-06-18
gtggagcaggaggttttattgtaaagaggccgattgtacagagcaaagattgttctgacacggggggctgggtggtgggacccagaggccagagctgggtgaaggatgaggggtggcatcgccccatccaggcagtgggcagggcagggaggactaaacggctgcctcccagttcccttccctgcccctcattactgggtaagagggagccaggctatttccacggatccaggagaatatagcaggagaccctcaccaccccacaccatgccccaaggatacgggaggtgccccagtctggcttttgcagtcggccagctcccagcctcctcgaggagcagcctggccacacctttttcccctggagcctggaacagctggctttgggttaggaggctggaagcacccccttaccctgtccaggcacctcaagggacagcccgtggttccctggtcaaaccccttagggcacagtgacccattttggcttctgcctctggggctgggtagcacaggagtgggtgggcactgaggggccagcactgagccaggtcttaaagagggagtccgagtgttgggggcagtggtctctggtgggggcatagccccagagatggggctcctgtgagtccagcctaggggttgagggggatctgagccagttcacattgtcctggccacaggggtctctagggcatgacactcagggccactctgcctgttccaggccctgatcgtggtaatttaaagctcagaatggtggatgggggaagcctcagggaccaaggccctgccttcccctagactgagcccctcgtcggcttcatcctcacacccgctgtatctcaaacagcttcacgtcggtgtcgtaccagacaggggggtccacattcctcagatagatgacgccccacatgtaggtgcggaaccacatggcagtgcccgagttggcctggtacttgcggatgaggatggggtggggcacgggcagcagcccccaccagggtgccatgctgcaggaaccgcaggatctcagactcatccgtcaggcccttgtcgatgcagatcttctccacctgcggaaccagcacctgcagcagcctcatgatggtctgcagcggcag

SEQ ID NO: 2637 - DNA, 571 bp, Homo sapiens
  ref <308>: DATABASE ACCESSION NUMBER: Contig56843
  ref <309>: DATABASE ENTRY DATE: 2001-06-18
aagctataaaaaagtaaaaggggccacaagctttattaaaagtaaatgcaacagtaatatgtacagatggcacatggtgccaattttatttgtaaatatagtactccaactcaagtttacaagttacacctttgccacagccttggctaaatcttgaactagtgcagaattcagctgtggtagagtgctgatcttagcatgcttcgatgtggcatacttgttcttgacagtcatgtgctttgtaagtccttgatttaccatgactacattcttagccaggtgctgcataactggaagaagagattcttcagtatatgacaggtaatgttgtagagttggtgtccattcaccattatccagaattttcagtgctaagcaaaaagctcctgctgcaatttgagaaggaggaaagtgcaccatgtcatagtccaacatagttagttccatcaggtatttggctaaagtatgttgctcgacatcaacctctccaatcttagatgctctccgaaggaagtgcaaaggtagaggccgacccagaccaaagtttaaagctcttagaatcttcatttcc

SEQ ID NO: 2638 - DNA, 996 bp, Homo sapiens
  ref <308>: DATABASE ACCESSION NUMBER: Contig57011
  ref <309>: DATABASE ENTRY DATE: 2001-06-18
ttgcagataatttctttattgaaactatcaggaagttttactatgaaattttacatacatgatggaaagtggaagacatataccaattatattccaggaaaaaatactttaatagtattgttatatagtgtattggctaattccagtggatcctcatctctcactgctgacattatctccaatatttgaattatatggcagggttcatttctgtcttttaagcagtgcccactttcccacttctttttggtaggaaatgcagttcttatatattttgatccagcatgtgtacttttgactccacaccaaggtgcatctgtctcaatcattaatttttcactaggaattgacttcaaaacttccaaattagcttcagttttcagtgagcaaccattaaatcctatataaagatccaagtcaatcaaagcagctgctgcttccttggtaccatcaaatgaatgcaccactccccctacacaccgatctctatttcttttcattatgtccaaaaattcagcatgtgagtttcgacaatgaagaaacattggtaattttgtttgttctgacagttcaaactgtttttcaaaatatttgagttgagtatctttgggacaaaactgcagtcggtcaaaatcaagtccgcattctcctattgccacaactttccctttattgttttcagcaagatttagcaactcctttaagtaaagatcagggttattcttttcaaattcaccacatcttgtaggatgacatccaactgtactgaaaaacataccatttgtttgtgccaaatgcagtgcatctttactgtcttgtagatttccacctgtaatcataaactttttaacaccaatctcgacagctctccctattacatcctgtaagtcatcttgatgcttttgaacccccctataaattcctctgaacatagggtcagtcaagttgataccaatatcgataaacttgaagcgactcatgactgcgcatggagga

SEQ ID NO: 2639 - DNA, 1420 bp, Homo sapiens
  ref <308>: DATABASE ACCESSION NUMBER: Contig57023
  ref <309>: DATABASE ENTRY DATE: 2001-06-18
ttcactctgcaaccattttactttattactttatgggaaaatttagatatgcaaagcaatgcagataccaaaatatgctttccaagtgtttttggctgagtttgtctctttcagcagttctgaccctaagatacatacttatatggaaaaagctatggataaaaataaataaaatacatcttaatcatcaatatatagacaaaattgaatagaaaaaagtaagaacattataaagcatgaaaatttacataaaattattcctgaatgtgagggttgaaagactctagaggcctgaaatctatttgaaagagaaactttcaagaaaaggaaaaaagcattcctctacttagaatagatatgctatgatctgattctgaagcaatgggattgaactgaatgatatatgaggtttcttccatggcccactgatttagatgatagcagtaaaaaatatattagtgaaaatcatttaatactgtaaaagaataaacagatctggacaggaattccgtaaaaatacatgtagacgttagtctaaatacatttttaagatacaatatattttgactaaactgacaggatatcaacagctcattcacttgacagtcatctgttataaagccattattatataactttaaaatatatttacagacttaaaaattaagataatgcttttatgtacatcagataaaagtttaattagagtgtagagtgccacttcacaggaattaagataatcatgttttaaacaaaatattttgccatgaagatatagataaaatgtacaaacatgtcacatgatacagaaaaacaagaatcatgatcttcacatttacaggaatttaaaaaatcttctctgatggaaatgtgttacaactcaaacttctcttcttgaaagtaatccgcaaaattgagatattcttcaagttgaccatatttctccttaatccagccattttcttttgaccgcctgaaaattctttccactgtttctttaacttgttcatcttcaacttcttctgtcattgcaatggtgcaacattcctggtatagtttgaatttaaaatgtttcagtttatgataaattctggtacggctggcacaaattctgccaacagtgaacacctgtttatcatgtgacatgaaattatctatttgcatggtcctggtgttatacaactctcctgataaatgcactgaatatttacagtagcgatgcagtccacaagcctggcaggaacagttttcaggattcttcaaatgaatacttacattagaataattttctactcgctccttatattgctctttccaacgacttctagataccaagctctctagacgaggctgaacaaagcggttatccaaataatgaagagatgttagcatatcttttgcatatgatttttgccttgtg

SEQ ID NO: 2640 - DNA, 632 bp, Homo sapiens
  ref <308>: DATABASE ACCESSION NUMBER: Contig57057
  ref <309>: DATABASE ENTRY DATE: 2001-06-18
caatagagaatctggatctattgaaacatgtttaaaacggggttggtcacaacaggatgggcacaaatgggagcgggggaggggagtggggccgcaccagcccctgccagtgcctgaggctgcagcctggcgagtgcttttgcttctgcttctccacgctggtggttcgagatggtcccaagccccactggggcaggccctgccttgccctgcagaggcagggtggctccacttccccatctcctcccccatgggctgcaggggcatttatgatgcccaacaggtggcactgtcgcgctccttcctccctgtctccgtggctcagaaacaggttaagggtagaggtagatggggagacgtgggggccacacagtctccggtggcagtgagggagcttgggaccctgaggggggcatgctgactccttgctggagaaaaggcacctagataggggagctgggcttgggggcctcccagggggtcctggggtgaggtggggagggaggctgaacgaagcaggaagcagggtggtgggcagaccccaatcctggtttccaaaccctcaccggctgcgggagaaggaagaaggaaggagtcctggacagagcctgccctgatcccctacgcctgag

SEQ ID NO: 2641 - DNA, 1237 bp, Homo sapiens
  ref <308>: DATABASE ACCESSION NUMBER: Contig57076
  ref <309>: DATABASE ENTRY DATE: 2001-06-18
ctaaacaaattttcacattgtaaacaaagcgtcctattttgtatttgagttttgcctttttcttcctagggaactataagagagtttctgtgaccattaagaggactccattttcaccgctgaaatagaattattgcccttatagtcttgctggcaaattgttagaaaaaaagtttatttacagtattttgcttttccataccaattctagtgagaagttcacattcttaaattcccagtcagcaactgcatttctcccctccaatgtcctctccatgacttatctctgaagtttcgagccaatgtttaaaatgtacactatttacaaatgaagtgtccaaatgccatattcccagctctccagtcagcagggggacccttctgaagtgttgtcatgtgctgggattcagaacttgaacaagttgataaagtcctggggtgaaagtgaaacggagcagctctctgggttattggcagtgcacggatggtcagtgcccttccaggaaaggatgtgacagtgtttgcagagctgaagggtatctccatactgctctttccttgggtaacatcggacaagtttgaaatacatcttcttccaatccagctgccctttgtctgacagaattaatcgtttgcggatctgccgctcggagaagtggtactggcagagtttcttccacagcagccggtcttcgctgagcacgtgcaggtcgggggcagctggcccaggctgaccaggtcccgcccgtcgctcagcctctgcatgatgttcagttgtaggcacaaaggcaggtcagtgaaggtgaggcctttgaaggcaggcctggtgatctgaatgttgttcagctgctgctgccagtggagaatcgtctccatccgatacacccacatgttaatgttcccgaccagcacagacttgccgactctttagaccagtgtacataaggatgtgtagagggtctggagtagttcccttattagtctaatgttttgctggtcttcaaggactttcagtaccactttttccaaaatattcatgaagttcttttggcgatgccactcagggatgtgagctgtgactttgctatcagctccaacagccggaccacgtagttaaatcttctggaatccagaatggcagttgagaagtccagtctgttgaaagcttcccccagggtgcaatatccatggcgctctttagtacttcctttgtgaacatagatccatttttcttggt

SEQ ID NO: 2642 - DNA, 1012 bp, Homo sapiens
  ref <308>: DATABASE ACCESSION NUMBER: Contig57081
  ref <309>: DATABASE ENTRY DATE: 2001-06-18
ttcaaaacagtttattttattttattttttttttttgtcagacaaacacattgatttctggaccacagtagaggatggaaacctttcacaaacttatttatttgaaaatacaaatataaaattatactttccacatctgtgatgtgagagactgccatccacatagtaattttttacaacagggctttaagaaagccacacacaaagacctgaaagatgcttgagatatatatatagatagatacatatatatgtatatatataaaaaaaatactcactaccaaagttctcatcagtttcatactaaagtataaaagtaagggtgaggtcagccacagtgctagggaaagttttatttagatacatttatgtccacatgaaacgcttagacttgcatcctattacatatggaattcggagtttacaatacaccatgaacggcagattggctagcccacgctacttaagaggacactcacagattccacatgggatggtacattatgtacagaatacagtagtagagaaccttcgagggaggctctggaacttttgtctctcagcctccggccccctcccccatcatgcccctgcctcccggaactgaaatcctgtctgagacaatacattctgattatttgatagccaggtgtttggattaaggttgcccccctgcaggtccccgacaagagggatggattttatttatatgtttttgtgttttagtttacttacttttttttggtagaaaaaaaagaaagaaaaagaaaacaaacatattacagtattaaagtattgcttaacttccagcgtctccttgtgtagtgtctgtgcccaggacggggctgagctgacgtctgctagttttctgctttggggtgagggtggggaaacccgccagtgtctttcttcaatgtgcttgcctgcagtcagtccctctgctctcccactgtctgccttccttggaagatagcctggcttgcgaagcacattcaagaaaaaaaaaaaaaaa

SEQ ID NO: 2643 - DNA, 706 bp, Homo sapiens
  ref <308>: DATABASE ACCESSION NUMBER: Contig57091
  ref <309>: DATABASE ENTRY DATE: 2001-06-18
caagaaaaaaaaatcactttaattgaggaacactttcagtttgtgacaaaattatgctgtgaatcaggtgttgcaaattatggcccactgcctgcttttgtgtaagttttattggaacacagctacattcagtccatggctgcttttagaatacaacagtagactttaacatttggaacagggaacagaaaccagagccatacagctaataaacttgaaaatatttacaagttgatgctttacaaaatccatctgctgacccctgctctgtaccattgttctcttctgatggtctgtttactaaaaaataaaaacttcacaaacatgtaaaaaatagatttgccatttaaaatgtgcttttcaagtttgactttttaggatgcaattaattcactaaatacagaacttaactaaggacaaaaatttaaagatcagcattctttcccttcccatcacgctcaacttaacatgaagaactgtaaacatcctaagcttacaacaaacctatctagttagacttcagttaaccacttacacatccccctcccccatgaactatttggaaaaagctgcaggcgtaatattggatccctaaatactttattctccttataccattatcagacccaagtatcatctaatagtccataatcaaactgcctaaacagtttctacactgtctttttaactatttcaaactatcaag

SEQ ID NO: 2644 - DNA, 1125 bp, Homo sapiens
  ref <308>: DATABASE ACCESSION NUMBER: Contig57138
  ref <309>: DATABASE ENTRY DATE: 2001-06-18
cctgagaagtcactggtgtttaatggaaaggtatcctattagtccttggttaagataaggcagtaagagtatcactaatactatgtttttgcttagaatgaggctgatccttccactggcgtcttcacgggcaattagttccctctcttttgctcctagaaacacaggtaggagctgtctgccccctattgctgttgcattttctgagtgtgttgaaggctcatctagtctcatcacagcagcttccccagtggggatggagcgctgtatattgcattgtagcatctctccaggaagtgcacgggccccacagaggaaaacacaggcatctttctttctgactcctcttctgtttctcttagggacggggcccataaatgattccttcacatgatcaatcagaatgcgagacactgttgactaaaacataaagcaagtagccctgatttcagagaaatggagttacaaataacattttcaacagtgccttaacttgcaaggtagcttttactgcagaaggatatcagctccttttgtctacctatcagaagagaaacaaaccatttccgtcgaactagaaatgcttagctcttatgagaatattgtgcttttaaaaaaaattcaaatgttaacattatttgcagtctgtgttctaaggtttcaatttgttttttctctagtccatttgatcattgtctctggtgagcgatataggaatattaatttggcatagagatcttcttctagctccagttctcctgtctctcgaactaaaaaaatatctgtgcacaacttcaaaattcgatccacatttggaagctcttcaaacatgatggagtgagaaatcccactgaagaattcacggacaaatttcccaatcacaaggacaactgaagcatataatcccataataccatagccagccaggaaccccagacttgggggactgactttgtcattgaagaccaccagttccagggcctgagagttcggattgtatattctgtttccagtcaggttgagaacccaccactcactgttatatttagttgtattgtctctggacaaaatgatggtaatatccatgaaattattttcagataaaagttgctttataggttttga

SEQ ID NO: 2645 - DNA, 1279 bp, Homo sapiens
  ref <308>: DATABASE ACCESSION NUMBER: Contig57173
  ref <309>: DATABASE ENTRY DATE: 2001-06-18
aggtttcaagtaagtgacttttatttttctctgacatttcacagtcaatttctgcaaaacttcatactttctcaaaagaattcacatttgctaaataaatttctaccctaaagaattcatagctgaaaaaccacttcaatatatgcacaaaagttacttttctgctaaaggaaccatagtagaaaataaaaagtcagacaatactataatcaataaaaaccaatgagtgtaataaattacaaatgtcattaaattccattcccataaccattgcaatcagcaacttttctatatatatttcaataatgccaacaaaatctgccaaaagttctcttaagggttgctctgagctaaaaatggcttctcaccttcagaaaacagcagctctgccacagtacttcatagccaattacgttattcatcgctaaaaccatcactacttacagccttgggcaaccgatggagatctttctggtcacctccgaggttcctccatttgctgatctggcttctggactcaatggatctctccttccaagatctatcttctctacttgggttcatctgcttacagctccaacagagaacaaatgcccatggtaatagcctggagagacttctagcactaagttacaagattagaaaagagctgagagtggtgctgcttctccctgccactcagcagtgaggattgatagtggctttcatcatcttttactgaaacagggagggaaatgcaagccttaatctaggaagaagagtccaagaggcttatagctccacagagggtttttccaatggaataaatttggttctcagcaagtgttttcagatttttgacacagtaagactcatgactggtgcccaggatgttctgaatgcacctgtctctatagctttgctgccaaacatattctgccaaaaaggaagcttcctagcatggtgcacagagtagagctgctatagtaccacacagattcaggggaggcaaagagagtgggccaagagaaaaatattaaaaggagctgaatctgcctaaagacacatttgttctgatttctgaaattctttcagaaagcaaacagcaggtaataattctgcgttcatgagtggagtctagggatgttaccaagttgttcacttctaaatcagtcatatctaaatcacacgtttgtgaacaaagtataggcaatctgaagccacatactttttaaactatgttagagttacaactacctaggaaatgtcatatttaacttctggtcttggtaaaactttt

SEQ ID NO: 2646 - DNA, 1373 bp, Homo sapiens
  ref <308>: DATABASE ACCESSION NUMBER: Contig57230
  ref <309>: DATABASE ENTRY DATE: 2001-06-18
acagtgagaacagacctttttattaatatattgagataaactacagagactgaaagacaaaaattcatatttcattcagaacattcattaaaaatcaaatgcatttgagttctcacagaaaattttatgtaagtctgatataacattaaatattttacaaatcagacatttcattttgaaatctaatttttaatcctgaatgcattatagacaaagtaagctctcctttaccaatttcatttaacttatacaaggcttccattataattccatcaaaccttaaaaattacctgcagcttttaaaaacacataaagtaaatggaaagaaagtcttatgtagcaatccaaaaactaaaactagaaattggcaagaagcatttcttaatacagataaactgcaaaatatcatttatgtgtgtttcttctcattggtttaatcatcctattaaaaataattttttgaaagtaataattacaatactccaatgtcactgaaaatctctatgattttaatggtgtccttaaatggcaaagtagaatatcagactgaaatgtacagagtgttgtgctgaagtgaatgagacttgccatgccaggtgtcatctgctatgcagttacaagacatcttggcaactagtcatcccagtttttactaacttactaaacaaggacatttcaagaaatacttcttacccctatgtatttccagatggctggatatagaaagatataattatgtttgaagcatgggccttataataggaatctctccattaaaatatgaaaaagagcaacaaataattcacaccaatgaaattgtgttgactgattttcaaagtcagacataaaaatatccactgctaatggaagccctgctctgtgcaaacatagtgtggtatatattaaacaatcacacatttgaggtaattagctgggaaaaaaaaaaaaaatatatatatatatatatacacctatacatagacacatccacagaatattcacaaatctattggccccaacaccagcagatagtcatattaaatgaaaaatatcacataccaacaggaaaaagttacacatagggaatatacaaaaaatatggtgctataatccttaatataaggagtatgttttgaattaatgttttgaggaaaagtgtttccatttatatgaaagtatctatttaatagtaataaaaccaaaaaggaagctgaattctaggactgttttacctgccaaataattgaagggatgagcaagaattccttgaaaagcctcattctatcctttttctttgtaactaaaaattagaatttaaaatgttggaaattattgccagacaagtttcttttcattggtttatagggaatttt

SEQ ID NO: 2647 - DNA, 1381 bp, Homo sapiens
  ref <308>: DATABASE ACCESSION NUMBER: Contig57258
  ref <309>: DATABASE ENTRY DATE: 2001-06-18
ataaaaactcaacacacattggattttaatgagaaaataactgtatacttgcattgaatgcctcacaatcactctaaaaccaaagcaggataataacatttaagtggttaacatacacaggaaaaccagatacagagtataatttccaaacacagtattgctgcttttttcccctcctcccccaaaaaaagaaaaacaaagaaaaaataatttgggtaaagagcaacacaaaatcaaaattggcagctcactgaatgcttaaaattcaggaaatttgttctttaactaaaatggaatatattcaccatctctaacacttaggctacttttttttcaatacatagtttaattaaatccattctttagttgggaaaaaaaaggtttaattatttgtcttcagagacaagaatcaacactgttttagtgttccttgttacactttatatatatatatgtgtgtgtgtatatatatgtggacattgatctatatacggcttatatgtcattgtctagggtgagcagcatgcatgggtatgaagaggcaagtaaactgcattgtgtcatccaagtaaaacacagcacggcctcctgccactgacagaccctgtttccataatttctggatgagaaagccaagtcatgtcagtagttaatcagctctggaggaaagtgaacacctataaacacggcagaatgcaatacttccagaaaggcttttaacacctacagaatctaaacattttgtaagaggtggggttaacaagcttgtgtgctatttgggggtggggctgagcatcagaggcaaagtttttcgtaagcctctttctctcgatggattaggcaggaatgactttcctccaggggacggtcccatcttcagaaagttaaaagggtccatttgggatcccagagcctagcacggtgctatgtacaaagcggtggcccaaggtttcttgaatgaataaaaaactcaagagcacagagaaaatctggctctcccaagtaaactgtaatttacattttcatgggattataataggatcttcagtgagtggagcaagaagatagacagcagtaatccggaaggcagcataggagtaatagcaaaagttaagagatgtaggggccacagtgaaaacagctttgtgactgtgggagagtcccagaaacagtatttctttccttatccacacacggagcatggcccaagaacccccagctctagaactctgttattctttaagcaataagtgctctggttcaatcaactgtggtcaaagaccacttcatctgcctctaaagccattccgcgaatagtgtggcctcttaagcttttctctttagctgtacattctcttgtcaactgtaggtttcatgaagc

SEQ ID NO: 2648 - DNA, 877 bp, Homo sapiens
  ref <308>: DATABASE ACCESSION NUMBER: Contig57270
  ref <309>: DATABASE ENTRY DATE: 2001-06-18
gaatggagatgaaaactatcatttatttcaattgaatttagtttcattaaaaaattctatgataacattaaaacagaaacaggacgtttatatgactgtctttaacctcaaaagtccaaataaacatatagacattttgaatatagctatcattttaacaaacctcattatgatcactgttgcaatttcagtcacctaaaatacgaaccatgactattaataaacatttactgtgtgtggtttgttggactgaacattaaccatacgtgtatttctaagtactaggagttgaacagctactacggtcaatgtattttggcagttagctgtgtgtggtgtgtgctttttaaggcttcactcaataaaacatctgttgctctctgctgatgagcaaaaaacttgctatacgaaggacaaatatatgtatacaaacaaatgcacacgtgtgcatgtctatatacatatatgcaatttcagggaggtgacaccttattctgagaggtcatgagactccacttcaaaccataatagtaaaacctttagtaaactgaactcaacatattacagccaccatcatcaggaaaaattaaagactcatagttcaaataaagtacaaaaggtcccaggaagtattgtggtttgttgattcattcaacagaaagcccaaatgacaatgctattagtggtcaggagtaaactaacctggacaggctcatgaaaatgaacccctggatgcatcctgagaacgtactgcataattatagtcaatgcttgcaataattttcagtttgtctcatcacgttagcagagcctattcatgcaatttagaaaggatttcaatacagcccaaaccaaaaggcttacagtcaacagaggg

SEQ ID NO: 2649 - DNA, 1227 bp, Homo sapiens
  Modified_base 1 ... 1227: n = a,c,g, or t
  ref <308>: DATABASE ACCESSION NUMBER: Contig57272
  ref <309>: DATABASE ENTRY DATE: 2001-06-18
cttatttaaggtagccttttattctgattaattaagatacatctttaagggttattctggtggtaagaacatttatcttgacttatgtttaatttttttaatgctttggcagatgaagtaacatttgaaaactgtttgtgaaaatagtatgagactggaaagattacgtcgtggtaaaagtttcacagttttccaggtatttccttatactgaagaggccttgaggcaaattcaacattctggaagcccagactgacaaagcaaaacagattttgatgttgcctttgttgggtcctggaaatgatgctgctgcttggccaggcaggaggaagttttataatccatcaagcttcccagacagtcaaggccggaggtcgctcctgtcctgtggtctgaccctcagccaggccatattactggaagaaagatactaagatttgcttgccaataataatttaagtttttaaataaatatttaagtgccatgtttagcatctatttgtcctggcaacacagcacttgttgccccaggacccagcttcttcagcgcatgaagccacagattcagtcaattcggtttccacaaattgtgaacctgtctatctctaacaaatctttctttgaggatctgtgttttaattcagaattgtcctgcgttatgtccttctcgtcaccatctggagttgtcaaaaactgatcagaattgcttgtcacaagtaatggtatgatattttccttttgatgaataggttgtttggtgatggaggcagacaggttttcttctgtggaaaggccttgagagggtttacatttgttctgtgatttactggacggcttgcctggagtgcaggttgcgggaggattcgacagcttctcttccattttggctncccttcacatactggcacgatttccccaacagcacgatgctattaagtactttcagggatatcaacccaaaatagaagagtatgacacaggcataagacaggattccttgcactttaattgagcttgttacaactctgatgagtaaaacagctagtgggagaggaataaagcccatcctccgtgctacagagtcactgtaatcagtgtatgcatttttctgtcggctgctaacaaggtcaaaagcaagactggctctatattcactgtagacatctgcagtaatgtcattgaatttagtaataaaggcatgttttacaatatccacggcaatttctg

SEQ ID NO: 2650 - DNA, 1025 bp, Homo sapiens
  ref <308>: DATABASE ACCESSION NUMBER: Contig57344
  ref <309>: DATABASE ENTRY DATE: 2001-06-18
ttacctacaatggtcaattttattacaaagaactgtatcaaaatatacaagtctgtttaagaacaaccaagaaatgcagctgtttaagggacaaatgagaatcaaccgttagagagcaggcagcctctccccgccgctgtccactgcaggagacggcatcctcagggccacattttccacgggacatccttctgaataatttaaagggtaagtccggcacattacaggtcttcgcgggagggcagctgtgtcgggctttctccttctgtggcttcagcctctgccggcggcacacaggcatcttccgtttcttcgaagccgtcaggacacacacagacgtagctccctggagtattgtagcagttttcgtttttcctcacacaggttttttctgctagtgagcactcgtccacatctgcacactgtccgtgctccctcgcgtagccagagatacactctttacagtttcctgggccttcccctgtgcagcccacacagctggagtcacactcttcgcacgtgtaggagccgttggcgttcttacagaactgcgcagcgctgcagggacggtcggccgcacactcgtccacatccacacaggcgccctcgtccagcacccagcccacttcacactcgccgcagtctctgttggtcaggcccgagcacgtcttgcaggactcgtcacaggctgtgcagatgctgtgggtctcgttccggagcgagctgaagtagccgtccatgcagtcagtgcacagcgggccctggtaccccatgtggcaccggcaggacccgtcgccctgtctgctcccatctccgctgcagtggccattcccgctgcagggcctctgggatccgccctggcatgcgagacagtcgggaccgtaggttcctggagagcagcacactttcagtgtcttcacacaaaaccactcgaataagtcaggatattcgctcttcagctgcagccaccaggcctccaggtgctcctcctgcgcctctagcatctgattgcattcgaagtcgcg

SEQ ID NO: 2651 - DNA, 1197 bp, Homo sapiens
  ref <308>: DATABASE ACCESSION NUMBER: Contig57430
  ref <309>: DATABASE ENTRY DATE: 2001-06-18
atgtattttgaaaagtatttacttagtttaaataaattaattgcaaataaaaattaagctacaatatatagcctgaataaaaatgactagaacaaatacaacacaggacttgctttcttgcattagtcacaaagcatgtgacaatctagaaaacttcaaaatcaattacatttctttgaaaaaggggtaacagcagttactgatacatcacaactaataaacttataatacaagtttcctgacatgcatttcctgagtgaacccaaatgatcattttttaaaacaaggaagtttcgacagttgaagtaaaataaaataattcatggcttctaagcaacaagttttgttttttaaaaaccaaaagaaaattcagaacagttttgtaataggataaattaaaggtatgctaccacatataaaactttgctacagtcagttaagtattatacaacttttcaaactaaaggaaaacaaatcaaaatattaaaagaagatactgtctaatctaaaagtgtactggtttctacaagtgtcaaaaaaagatttgatgtagtgcaactgtctatacttgtggtgcctttgaaaaaagggtgggaaggaggggagagaagaaacttttcttgcttctggaagcaaaagacatattggaattagagaataaacagaccatgcagtgcgtcactccacgctgcagtcattggtgctcatctgccaaccaaacatttccttaagtctcactgtggcaatctccttaggattcaaacccagagttaaggctggtctgctaaaaacgggggcactattgtcattcaaccctttagatctctagatttcctaatgcccgaataaggccaaatacagaataattaattaagcatttctttttccaaaagcaaatcaagtcactctcctttcttgctaatttatactttttcttatggcaatgatttttttctagaaacagtgaacagatgaaccacagtttatatccaaaaaataaacttgccaaatgctgctgatactaaaaacagattagttatcatgggagaaaaatagataatctagattaaattgcatatccaaaggagcatataaaatgtttcttagcattaagtttttgttatagtactacgctcgagagaaacattaagaaaaaatctttcctgattatcttcaatgttgttaaaaacaaacacc

SEQ ID NO: 2652 - DNA, 2135 bp, Homo sapiens
  ref <308>: DATABASE ACCESSION NUMBER: Contig57458
  ref <309>: DATABASE ENTRY DATE: 2001-06-18
aagagtatttattccaaacacaatgttcactttaaatgcaaaatagctggtagaaaaaaaacactgaaaaatatactgaccctttgccccatatacagacatcagcctttggtatttgctttcaggtaattaggtaaaacaaacaaacaaaaacttgaaactattatttatctccaagaaaacaacgtagagttgaggtattctatttaacagatgtgatctccatccaataaggtctctctgttaattaacagccttgtgacatgctgttccaatcctttcctcctaaagtagaatttcatttgagcatatgttcataaaactgacagtgttccttaataatcactaaggttgccatagaaactccctggtgctggtgcccagccgcacggaggacaggaggccttcacagggcactgaggagggcctggcacggaccctgaactggcccgcctgcccctccgtgtgcagcccctgcccacggctgcacgggacagctgggtgcagggctcttgcctcaaagggtcacaggttgcccctgcatctccaaattaagaccaccaactccacctggagctggtgtcagcatcctccccacctgggttagccttctggacgtgctgtgagataatagagctcagcaccaaagcagctgggaagacattcctgaacattctccaggaaacaaacccatagaccacaacatgcccagcctgccccactgggccctgttcactaccaggtgggcttccagcctggttccagcaacagattccacaacctgccgcggcaaccagtttcctttctcccaagacagcagggaagtgccagaggctccgtgtgaactcagagcctgataaaagaaagcgtaagggcaagtccccatcagggccaagagctctctgagttaccaaaggcctcgtcaacatagccagtgctacccctggacacatttcttgaaaatatttcattaatgctacaaacattattgatcattttactttaggccttgaaccagcatattttttactttccccacccagcaggataagctgtcgtatttaacctaaatggtctctgtctcagcgtttcacgtctggctgcgtggcagatggctacaggtgttaggcaaataacagcactgctggggactcaaggcagtgggggtgctgcagaaacacaggtagaaatgccccgtgcattgagacacatgttcagtcaccacagattagagaacatagagagcttaggatgtatacctgtgtacgctgagccaggcctacagcccagagaagacattttttcttcatttacattagcttatgaaaaataaagggaaaacaaccctcttcaatacaaaaacaaaaaaacaaaacaaagcaattccattacaataaaaatgaaagcaataacaatttggagatcaaagctgcctagctcttggcaataatgagctatctggatttcacatcttccgctagcatggttctgcccggctttggtaacaccacatgtgggtaaaacggtataaagaattgaagaactgtgggcacagaatcacccttactgcagattctcattcttaatatttccctttaacagcattttgctgttctcaagtctcagaaactttatgtggtgggatgggagggaaccaccataaccgcctgcctgcctttttttttcttaactgttattgttcataatagagatggtgtctcactatgttacccaggttggtctcaaactcctgagctcaagcaatcctcccaccttggcctcccaaagtgctaggattacaggcgtgagccaccgcgcccggccatcctgcctttttgccaacctaagatgagttgcctcaagcagcaatagggtctaaaatctacagacaagcccagcaatgaaaatcacggcttactgaagacagtaacagcttaaacctggaaaaccgtaaacaaaacatggtcactttcatcctttcgcacctgtctggtgatggtggtggtttttctaagagggtagagtattagaaaagttttgtggtctggtaaattttgggtccatggttacacggctgatttaaatcatatccccactctggaataccctgataacttgagagctaactgggtaac

SEQ ID NO: 2653 - DNA, 1116 bp, Homo sapiens
  ref <308>: DATABASE ACCESSION NUMBER: Contig57493
  ref <309>: DATABASE ENTRY DATE: 2001-06-18
atacttaaattaaatagcatgatttaatttagttggtgcttaaccctgaatcctcttaagttaaaaaaaaagttataattaactattaacgttaatgaatttaaaccttccagaaagcatgaatccaaaaggaaatgtccaacaggtgatatgaaccagatattttatggcctttcctgtttcagtctcaaactttctaaacatcaatggggaaaaaaaattctctagagtttttcagttttattcttctagagcacaattttccggcctgttactgagtacggtcttctaacaggtacacaattaactcataagtagacaacacaatggcagtatttgggatctgccggataagctgggcaaacagtcctctataaaaggcaaggtagccttcttcccggaacaccaggcgcgccgtctggacaaaagacttgtacttggtgccctcttcccggagcctcgtccttatgacttcgtgtggataagcaatgcaggaggcacagcccttagaaagagcagcagctgccataagtccaaaaaaacttgtggaatttttctcagtcccatttgcagaagaggctaatggagcttctttcagatacttctttaaactttcataaatagcaaagcagattatagtttcggaaattccagcatacgaggcagttaatcctctatagaagccacgaatgcttcggtctggtaaacgtaacgagcacactggagtgtattcatctgcttagagcccctcactttctgttctagctgcattcgggttttaaccatccatataggattcattaaggaatttgtgataaaagctgcagagccagctgagaaaagatgcacaatattgctgttaggcacgaaaatgccattaaattgctctttggctttggagtaacatgcaaagtatacagccttcagaacctgaaagagtccaggtgtcacggatgttggtctcaccattccagctccactaatggtccccagatgaacctgaggatagtagactgtccggagagctaatcttgaagactgcaaccgtgtcttaatgacttctagtggacaagtgaaaatagcaccaactgtgcctccacacccgccggcgaagag

SEQ ID NO: 2654 - DNA, 1118 bp, Homo sapiens
  ref <308>: DATABASE ACCESSION NUMBER: Contig57584
  ref <309>: DATABASE ENTRY DATE: 2001-06-18
acatatacctttttaaagtaacatttaaaattacttcctttaatataaaagaaacacacaagacacaaagaaagcccaataaagctgtgagtcccagtttggtagctgaggaggagtctaagaaaacaagccattcctcagtatccctgggaaagaaggggtgagaggacacagatatcaccaggccctgggtgactgcattgctggggccatgcagggcctagctctccaccaagggaaagtgctgattttccttgtcatggtcctggccttgctcccatgctcgtcctccagttttcagaagtcgtccagttccaagaatggctccttcctttagttcactaacattttcacttaggggtgaaggccgcttaccctgtcgtagtgtcagggtgccaggggagttgtcatcctgcaggatggtgaggggggatctccctagtaccttgctgctgtttggtttccatctattgcgcatagaacctgaagatctgggagtctcagggtcccttgagggcttgtcggagctctggctggccacaggggtttctgtgggctgtcttgcttcctccttggaaaacacctgtttggaggggaactcagtctggttccaaggtggcatctgttcctcaacagataactgggtacccagaggcaagtccaattcagaagataaaggtgcctctgggggcagaacaggctctgggggaagatttgatttagagtcttcagtttcaaatacttcactcagctgtttcaccagtgggcttggggggtctccactgctggtcttcataggtgtccgtgcaataccaagagtaggagagcggggatctgagtcctgggcatgtttaagaccctccagttgctcccctgctggtaggcctggctgtggagagctctccacctggatgggagtgcgcaggatgccagcactaggtgaacgggggtccgccactcgagccagatgcttgttgtcggcggaggccgcgctggtgtgactgggacgctcttggctgagcccatctcaaccaggagttgcagggtgggggcaagggccagcccgggacgaggagggaatgccgggccccaattccacctctggatgcacaacagct

SEQ ID NO: 2655 - DNA, 1551 bp, Homo sapiens
  ref <308>: DATABASE ACCESSION NUMBER: Contig57595
  ref <309>: DATABASE ENTRY DATE: 2001-06-18
atttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctgggattattcaggtggtgaccatcactggtctaagtttgtgtgcagggttttcagacgtgtttttgtgaaacttcgtagaaccatcgctaataaagaggacagtgttgtcagggtccatctgccctccatagaaaaatgtctctggctcataaaatgagactccctcaggggcgtaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtcaccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtacagggatcaggtccacagtggtgcagattcaaccaccacccagggagtgcttgcagactctgcatagatgttgctgcatgcgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcactattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgt

SEQ ID NO: 2656 - DNA, 613 bp, Homo sapiens
  ref <308>: DATABASE ACCESSION NUMBER: Contig57602
  ref <309>: DATABASE ENTRY DATE: 2001-06-18
gaatttaatcaacgtgttcacacacagcatttattttgtaagattaatttttacaaaccatccacaacttgttcaaacctttggctttatcctatctaatttcaaacaaatgcccagccttaatttattacaattatgattcgtagactttcactcaattacataaattcactctcggttgaggaaaagagagaggtggcagaggattaatccaaaggatcctggtgtccactacccttcaaagccagaccctggtggggcaagtcctgccaagtcatcaggtgctgattaaatgcagggcactgggtgggaagcaaattcctaaaatgtggttctttcccagaagcatcttataatctagctcaggggcttgcagctccaactcactccggaatcacctgggagcttctgaaaccattctgatcctgaactccaccctaaataaatcaaaactcttggtccataaactgaaaaaaaaaagtttaatctccacaggacattctaatgggcagccagagaggagatccactgatctaggtttttcataaattacttaaaaatttgcaaattataaaatatttcattaaagtatgaaaatctgaatcagttttgg

SEQ ID NO: 2657 - DNA, 1127 bp, Homo sapiens
  ref <308>: DATABASE ACCESSION NUMBER: Contig57609
  ref <309>: DATABASE ENTRY DATE: 2001-06-18
aacacacagagcagctgcggagcgactttattgtcttctccttcgacagcttcgttgtacatagctgggcccccgaggccctgactgtccctgggaaccaagccacgtggggtgaagctactttgaaacctcacccacagttcacacgtggtgaaagagaaaatctagcaaagtaaatccaacaacaacccaaattaacagtattattaacttcctaccccaagctggctctcccccaggccctgaactggctcaggaaggaggcaggaatgagctgaccgagacaaggcatcctccacccacacatcccatcttctgagtggtcccagagctgtgcgccacccctgtgggacaatcaggcactcctgggtctctaccagctgtgatgagacgtacaagaggagggtctgagcccagaataaacaagagcatcctgaggctggagaggcaggcccagtgtgcccggaccaccctgctctgcctgagaggatgggctgggttccagctggcccggccgccacctagtgactgcttgggacagtggagatgatgacaggatgcccactcgcccctaggcagtcagaagcggggtacacacaaacactctagaagccacacttagcaggaattcccagtcttccggcccaggggagggtgccaccagctcaggcagccctcaagaggaggccgggagcaacttctccagggccttcttctgcttctcggtgctgcagccagggcctcaaccagcttctcctcgggcatcatgttgagcaccttgagggcaaagaggagctggcacttagccgtgctcacgaaggcgttgctcaggaagttggggaagcctccgactcggtccttctgggtgtacagcgggacccgcacgaggcccacgcacctccaaggccgtggtcgcgcgagtgcaccgcgctgatctccacggcgtgcagctgctccagcgtcagtgccgcgcgtacaggtgcgccacgacgcggtgtgggccctcggtcaggtgcgagctcaggtagtcgcctcggtgaggcgcaggcagcccagcccaggccagcacccggttcaggccgtcctccagcgaccagaagcgccggtccacgaagccccgggaagcc

SEQ ID NO: 2658 - DNA, 1780 bp, Homo sapiens
  ref <308>: DATABASE ACCESSION NUMBER: Contig57610
  ref <309>: DATABASE ENTRY DATE: 2001-06-18
gcctgctgctatatctgaggttgtacttttgttctgatctttgtaacacctcaaaaaaaaaaatgggttaagagaaggatgaacagaagaatggatatgagacctatctgataaggcaagcagattaatagacgaatggaggaatgtttggatgtatatgtatatgtgttcattgcagttttcaactttttgtgttgaaatttttataaaaagaagttggagaaataaaaaacaagaaaacagaaccataagatttttatttaacatttttgattaaaggaattgtattgcaaattatgactttttaatttggcaacatccttttaatggtgttctttctttgtccttctctttctcttcctctctctctccctctcttccctaaagctccattccgacttagacaagggaaagggcactgcgaaatacaccctctcaggagatggcgctggcaccgtttttaccattgatgaaaccacaggggacattcatgcaataaggagcctagatagagaagaaaaacctttctacactcttcgtgctcaggctgtggacatagaaaccagaaagcccctggagcctgaatcagaattcatcatcaaagtgcaggatattaatgataatgagccaaagttttgggatggaccttatgttgctactgtcccagaaatgtctcctgtgggtgagtaggcaaatcaaaattctgtgagatacaatgagacctcttcaacattgactttttgcaggttgatgtaaacatcttatctatcatctaaaagaattatttttcaattctagaaaatacagttcttttcatttatttttgtaacttttttgtttttctttctgcttcattatgaagataactacaggaatatataacattagttcctgttttccaccctgtgaatttacctgaattcatagaatccttgcgtgctttaagcaaaaaatgtattttgtattgaaattgattcttatctcaattccagacacctatacagtgctggagacacctaccctacaccacgaaatgccagacagtaattcctagatcaaagtaaatgatctaaagcatgcatcacatctgatctggaagtggtccagaaacaggtgtgttgcatcttctgtagctgtaaatagagattctggaagggtgatactgtttccttttcagggtaaataacccatacttgttatgccatcaagccaagcagcaaatgaataatgtcatgaaaatattattagaacaaattaacaaattacaattacaattatcaaattaacaattagaatatagtagcaccatcattctaaaaatttaaatttgatataaatatacatttccatatcagcctaaatttacaaagtcctataatatgtaggatataaggtcaataagttaagaattccagccttaaggacaattttaaattataatttttattcctcagtcaccactgctaatccttcaatttatttcaaagtaacttctggtttttattacatttggaagataaagcaacttatcacatgtaggttacaacttaaaattcgtgtatgagccattgcttatattttctaaatctgacatgacccagggggtttctactgctcctaccaccacccaggacatgcgatgaagattgtgcacgctaccgtgagggcagaagcaggttagtagctgtaggagctgtcacatggatttactataatgcacttgaaattgtgtatgtgaccttatcaggcatttaaggaccataatctctccttgacctaa

SEQ ID NO: 2659 - DNA, 1472 bp, Homo sapiens
  ref <308>: DATABASE ACCESSION NUMBER: Contig57644
  ref <309>: DATABASE ENTRY DATE: 2001-06-18
gaaattttagatttctttatgttttaacaaattaacaacaatgataagaggacattagcagcttttcttgggtctctttgttaacaataactcgatcctgcagccataacaggggatgtggccaagttttagctggcagaccagtaagccaatattttacacaatggatgacatttctgaaagcagaggcagagacagacccaaagtcacacatgtagtccaacaaacaagtttctgccatttttaattgtatttagagcaacaaaagattccaagattacaaaaagagaacagaacactagcgcttggagctggtcctgctgcccagtggaggccaagtgccaccgtgagaaataagccccatctaaagagatttcaagcaaaattgtttcttttaagaaaatctttgtgtgatgctttctttctctctctcttatttcttttttccttcaatattgaaaattaatttttatctctgtttacatagtctgctccctcctgctgccagattaattccaaggacagcacaagaatgtcatgtctgaggcactccctaatcaatgttccagtctagaggaaagcagaaaggtgtcactgggttgtgaggggactttttaattttttttttcttttttttgcgtgggtcattctgatggtggctgctgtcagcatccaagtggcttatgggataggacaaccccccaggcacttcactgtaggacagttagcaccaagggctaaggttgtgagataatgcaaatctggcctgtcacctctgcagagtacaggttcccatactgtgaggcagcagccagagagggaaccaccagagaaacagcatttcagaattgtctttcctttggtgtatggatatgtgtgtgttctagtctttggtgggcaatggaatctgcagctccatgacaatcttgttaagtagcttatgtgggaagtgtttcaggtcacaagggccacccattctaaggcttctcatttaattccccaggctaagagacaggtggggaaaggaaaaaacctagcaccttgctatactgaattggaatcagaagccaatcaatgcatattacctactttctggccaaatcaaatgaggataaatcaaagctgagtcaaaagctgtttttactatgaaactccacctgctaaattcaaatatctaccactctttctatgggtgaaaaaattccaaaagatttgttatctcagctgaaatgtctgaagaggagtaactaatgtggatttttctgccttcacctagaaatggttgagttgggaggtcctaggcaacagaagtgtcaatctcttaatcaaagaaaaacaccctacctgtgggcagaaatggacctgcacctacagagatacaacttctagtactctgacaagttttaacagagaaaaacacattttcatttgtcaaaatctttacagaacatatccaaaaccagaattacagc

SEQ ID NO: 2660 - DNA, 1407 bp, Homo sapiens
  ref <308>: DATABASE ACCESSION NUMBER: Contig57725
  ref <309>: DATABASE ENTRY DATE: 2001-06-18
aaaggtcttgcaactgcaattttattttcttttgtgaaaataaacaactgggagtttaaattgctccaaaaaccataaaaacaaaaagaaatacacacagaagaagcatgtgaggtgatggggaagggaacagggtctctagaactttggcagattgtgctggcacggacccaggtgacaggagccagaccatggggccggtcccgcctgccactctgggattgtgaagggatgatcgccactggcaaggacggggaggaacacagacttcttcgctgaggaagtggcaggcaccttgagtccctttaaatgcgggggttgggaggaaaccatttcagaggaccgctttctccactgaaagctggggctggcgagttcgggcccactgagggaggggacgctggtggcagcaaatcaggccaagatgtcttctcacatggtgatggcctcacactgggcagaggacagaggacgaagaagaacccacggtattgagcagacgatgaaaacttgggctgggtaacaggaaatgtcacaatggcagagctgcagatggagtcggggaagctggggcaggcggcaggggcgagaagagacaggagacagaaagtgcaagagaggtaagagagagaagtgccctctgcccaggtccatccaccacagcacctacaggacgaatagcacgctacttttcagttctctttcttataaagatttttttttgttgttttgttttgttttttaaaaaagccttaagatcagctactggttacatctacaaactgtaaagtgctgttgttaccagccactttacagaacagtccagagtggtcaaatattgaccaataaagtctcctttttctttttcttctgaatcattactactcaatgagtcatgtgacagcctgcaggggtcggggggagcttagtgggcagacttggtgaccagggaaagaggctgggcctgtagcaccgggagggcctggtgggcatggagcgtggcggggaaggacgggggagaggccagcagagctgtgggcatggacccaagggggaggggccgggacaggaggggaggctggctgcccatctgcccagaggaggaggctgcagccttagccgacaggaaggcggcagagtggagagccagctgggcccgggtttctggtttggtggtgagggagaggggctgggcttgctccgaatgggtggcagcaggggcagctggtgaggccaaagctgcagagggagtggccggggagtccagcatgctcccgtgggaggaggcagggctgtcacagggcttctcggggggcaggtactgaacacatggcttcttgctcttggagcccagggcaccctctgcctcctaaacttgctgctgtgactgtgtctgggacagctgct

SEQ ID NO: 2661 - DNA, 1104 bp, Homo sapiens
  ref <308>: DATABASE ACCESSION NUMBER: Contig57739
  ref <309>: DATABASE ENTRY DATE: 2001-06-18
catattttaggaatatatatttttaaaaggattcaataatctttttaaagcaaaatcaaagtatggctacaggaggagaggaaatatccaaattgtaatcaatgcagattgtttacttaaggccttatatttgtacctgtataaataccatatcacagcacaaaaacataccccatctggctctcttaaggtacatgataaatcagactaatgcacattcatcaaagtggcatcatctcaggatatgtgcatatttgacgtgggtatgaattcagggtttccttgggtctctttcaaggactctcctttctcgtcggtatttctatttccttattttccttctgtttatgaagaactgttatttttatatttaatgcccaattttcactacttgttcatgtcagttctctgaaatgttactgcctatgaaccgtgacatgtactctttataacagaaccagaagttaaaagatgtagacatcacacaaatcaatgattattttaaaaatagaaaacaatgataaaaattcagttgccaacttagaggattttatacattatgaagtgttctattttccttccagggtctgaaatttatttctcaagaaaacagattttatttctaagcctttactatctttgctagaaacagaaaaaccagttttctctttgacaaaattgtcccaggagaacaacacaaatgctttttccaaattagagcataagtcttccttaaatgtcctagtgtgacaataaggatacaacagccatcttttaaatgtcatgaaggctattgttaagacggtgtttttggccgttttgcagatggtccatcgaagttagttctgttatcaatgttattttcatcttctgcatcatcttcatcatcaccgtccaagtcctcgtctggagccgccgccacccggtgctgcacttccccctgtaccagagggtcgaataattccgttaccatgtccttcatctgggccacgccagacaacaggccctggaaagggtcgccgtcacccggcgcctcacaggacacccgcagcttctgcggcttcccttcctgcccgacgtactctcccagcagctccatggtga

SEQ ID NO: 2662 - DNA, 1669 bp, Homo sapiens
  ref <308>: DATABASE ACCESSION NUMBER: Contig57825
  ref <309>: DATABASE ENTRY DATE: 2001-06-18
gcatacagaattattttatttaacttaaaccatgtagtactttactagaaaaaagcagagtaagagaaactaacgttgccttagcttcagccattcaaaatagacagtttcttttttccattatgtaaagaatccagagtatatcgcaataacaggaataaattcttacaacagaatatacaaaaacattttgaaatttttttcatctactgattttttatataaacaggattttttaggaataatttatacacagaaagtcattttatgtaacaaattggccatgttattacctttttttttcttacttaaaaaaatttttttttaacaagaaaactcagaaaatgcattatttgcggtgcatccattccatcccgccttctggtttgattttttttatcccagacaaagggatacccagaggtagacaaactctggcaaacctctcacctcaacctcactggcttagaaagcagacaggtgttttcaccgggcgtctcttccaccggtggatgtgtgtgtgcaacgccaaacatccaaatgaaaagttgaaaacaaaacccaaatagtttccagatctttctcctatgtagcgcaaaaaccccaggtgtttcccatgatagagatattgtggagttggggagacatggccaacaatccactggagttagaggaagtggagtcaactttaaaaccaatttttgtgtatgttatagtttttattaaaaattcttttctgtattggaaatacgtatcttcggggttctgccttaaataaaatagggtctcttctgtgttctaacaaagcagtaatcaatcatgatacgaggcatgtaagcaaatggcctgtgtgccccatagctgtcatcgtttatgtgatcactgtgtatgctgtaatcatcatgaaaaccattggctgtgcagtcaagtcttcccatgtccatggcactgtgctgacaatgacggcagccagaccaatcaagccagatgccgaacggtgccatgcactgctgggctccaacacctcggctgtttccatggccaatgaggttctttccatctgttaaagtagctacactccaaagggaaatgaccagtaaaaaatgatccccttcccaaccagagggttctggaagaccaagatactgaagatacagaactactttttaaatcatcatcattcctttgttataaactagggcaaaaagcatggggggaaaagagggtgaaccacggatggggtcagggagaaatccttttttggcatattgtaaagctagctagtaaacaggtgtcctaaaaaaaaaaaaaaaatggatcacaaacacacatttgcacacacagagaaaaaaaaagtgtctttaaattattttcggcaattataaactacaaacattttataaaattattctgttcttacaaaaatgcaatgaaacatttaattagttcttgtaaaccagatcttcgtcaactgactacccgtaatctactggacttaagagccctattgaaaacgctaatgagtgactagttaaaacaatgttgaccagaaagatgcggacacacacacgtgggacataaaaatgagtgatcgttatgttctcgcagaaacaaaacgctaaagtcatgccccagaactgacaactgacgagtgcgatgtagtttgtgt

SEQ ID NO: 2663 - DNA, 515 bp, Homo sapiens
  ref <308>: DATABASE ACCESSION NUMBER: Contig57864
  ref <309>: DATABASE ENTRY DATE: 2001-06-18
taatgttaattaactttattcacatttttccaagtaaatacaatattaactataagctaaaaacaatacatagttcttagaaaatacaaccccgaattattgtgtggcctgggctttgtgattatgtgcccagcctttgttcctccagaattttaaagtgaatgcagtgctcaaaacaaacttacgatagcacagggaaaccttccctaaataaagttttgttattagaagagaaatccaaaaagaggcctctactgccttcattcaagtgtcgagaatttcaaaatggaaataatattaaaagagcaatcgatttttttccatctcacactagtaggcttgaaggaggcaaatttggaccaaaaatctagacatagctccttgcatagggtttgatattaagcacacacttgcactgaataactccatatccaccctatagtacaaaaattcatttcaaatgcaaacgttgtgcaatgaccaggtcatatttttaagatcactctttaaaatat

SEQ ID NO: 2664 - DNA, 1498 bp, Homo sapiens
  ref <308>: DATABASE ACCESSION NUMBER: Contig57940
  ref <309>: DATABASE ENTRY DATE: 2001-06-18
attagcattcctttattttagaagttcacacctataattttataacaatcgtgaaaatgttactcagaactagatgttttgatgacacatagcagaaatctgtggttcaagatggtcattgcaaacttaaccaatctcagcattctattctgccttttgttttgattgcacagaatcaatataattctgattcatatggaaaataacttaatatcttaacctccgctcaggatcttcatcataaatgtaggtcagtacatacctaaaaattgtcaatgatccaacatggtcacatgtgacatgctacacttgcacctagtaccaaacaagctgatacttcaatgagatctggttggcatatacacccaagccttgtctgtcccctcagagcactgcacacagatagtgaaagaacttgtgtacaataagaaattcacagggatgaggctgggcgcggtggctcacacctgtaatcccagcactttgggaggctgaggaaggcaaatcacttgaggtcaggagttcgaaactagcctggccaacatggtgaaactccgtctctactaaaaataaaaaacttagctgggcatggtggcaggtacgtgtagtcccagctactcaggaggctgaggcaggagaatggcttaaacccagcagatggaggttacagtgagccaagatcacaccactgcactccagcctgggtgacagagcgagactctgtctcaacaacaacaacaaagatattcacaaggatgaatttaaataggtaaatggcagtgtagaactacatccttcctagtcaattacacctttaggagactttaaataggcatagaaacgacaaagggcttatactgagaattgcacaaaaatgagttacttggcagcacaaggtagggattgtatgtgtcacaagagtatatagactgttctaccttcatgctctactcattgccatatcccttcgtggttccctgagactcaggtgaaattaccttccaatattgcctggagaagggcctcctcctcctcagctgcctcataatcctttattagtaccaataactgcaagaaaccaggggctgggccatcctctggcagattaagctctctgcgaattgttttgtggactgccccagcaatgacttggtctaggcgggcctgattcacagcatctctctcaattgctcctctctgtaccagcttctgtaacaaaggctccagccttagtacataagccgacaacttttcctcatccttctggtaagtggttagatatttgacctgcaactccctaggattatctgtaaccccaaatacctcctcaagagcctgcagacattcatcgacagtaattaaaggattgtttatcttgaggacacgaataacatcaagtgctgggcctcgaaggctctctagcaatcgccttctcttctctacatctggcacctgccacgcctttatcatctgagtagtatgaaacatccagcgtcca

SEQ ID NO: 2665 - DNA, 1510 bp, Homo sapiens
  ref <308>: DATABASE ACCESSION NUMBER: Contig58260
  ref <309>: DATABASE ENTRY DATE: 2001-06-18
gattctcactttcatttattttcaaggcatatacaaaagtctgacatggtgcaatgatctcatcaagagataacagaacacacaggagagggttgggtttcctccccggcccaaccccctcaggaaggcacagaaaagtgaggcttgggttcgggggccacctgctttggaactaatctgctgctcagaaggccaggccccttctgaagagggatctcttcctcacatccagaatctaggatctggggaaggtaaactgaggccaccagtaagcatgtgctccaggccaaggctgagtctgtgctgcatccatgtcatcagccacccaagaaaaaccagttactccacctagctcatggtggcggcatcctccctgcaatggtgcatggggggcagtcctttcccctgcagggtgtcattgccacccccatcctcatcctggaggccagtccaggctccgatatgagtgactaggggtgaggtaggggtggcagaagggagatcaaactggagcattccagatgcctactactgccctcacacaacggggcaactgtgctctccaactcctccccttggcagagaaactggtcctgcagtttcaggactagacgagcgtggggtagtggcaataaaggggcttgtatgagaagtgtttcgcctctcatccctaggggcaaaaagtgaatcatctaactggtccaagtcactaatggcaatccttcttccccaagaagactgagtttcctttgtcacttcaggaagggaagaagagaggttagctgagccacccagattaggcccagatttagccaccacctagaacagggcaagctggaagtgaaagaacttgaaatactgactttttccttcttaaaaaagacctaacattgtaatggtttagcaaaattgttataatttcttttaaataacccacagacacccatgacacttccaaatttacagagcaaaaaagtgatttgcagctggttcctccagggaattggccccgaaggctggctcagttcacctccaggacctcagtctccgggaggccgaacttggtcttgtgcttgtcgaagagcttcaccagggcctccatgtacatggtgtggtacaggtcgatgtcttgctgggttgggtgctccagcttggggatggtgatgggctctcccacaacagtggtgatgggcttggagtagggcaccagcccccaggtgtcggaggagaagaggcctcgaccatggaagatgcatggggcgaaaccaatgtatttctggaacttcttctggacccatcggccccaggagccctcctcgaagatcacctgcttgtacacttcattctctccaaaggagtagatgggaaccaggtcagctccatgacgcagggccagtttcacaaagcccttgcggttccgcagggtgactgcattcttgccaggcatggagctcagagactcagccgcacccccgaccacgatgatgatagcattgccactcccattctt

SEQ ID NO: 2666 - DNA, 1198 bp, Homo sapiens
  ref <308>: DATABASE ACCESSION NUMBER: Contig58272
  ref <309>: DATABASE ENTRY DATE: 2001-06-18
ttaaaccttcccttaaaggactttatttctctatttttatatggatcatttattaaattagaagactaaaaagtaaaaatatattttacaatcaaagaaaaatctggacaatggaccccagtaaaataatcagaagcgcacgttctgagaccactcctgcctggcaccctgcagggtagcgcccagggagcatctgcagaggggagaggagaggagggggagcctccggcgacctgtcttctatctccggagccccgcctgaggctccaagatggcacagtcaggctgtccttagtgaccgctgccacggagctggcgatcggcctgcatcttcaaacccaggagcaggagcagcagaggctggcaaggcctgggccctcagacaccaggggcctaaacccagctcccaaacccactgcagcctccccttgtgagctggcagacaagcctgtccttctgagtgtgacgacctcatccacacctgacacaggcgggggcgggggagggtgggggttgtgaaccagctaattctggggaccgctcggaggggctcagcaagctgcttctacagtaagccacttctacagtaagccttcaaacaggaaataaagcataaaatgaaggaaagaagaatcttatttaattaaaggccttgcaaaatgtgatttgtctattaaaaaaataaagcgcttgtgaaaaagaaaactaagagatggcggcaagcgtggtcatcggcaaagggttgctctccctccagcgaggctggcccccactgtgtgggtccctcgggcccccacacgggctgctcaagggctggcagcaggggccacgtcctctctaggagacacccacagagccacatgtgcacgcgtgtggcagtctcactgcaccccagcaacgcgaaggcagaaaccggtgctggtggccacacctgggcgcctggacaccgaagcccccagcacagtgaggcctctgagtgtggcttgtggtctgtcctgggttagagttgttaatatcacggaacataccatctagaacgttccagtcccgcctgacaccttcattcccaatggagaagaaatctacacaggcgtaagaccaggccatctgagacagggaatcccaggggcccctccgtctgagtggtcggcgtctgctgaacaaataccatgtctttcttcttcaaaggatcaaaggc

SEQ ID NO: 2667 - DNA, 970 bp, Homo sapiens
  ref <308>: DATABASE ACCESSION NUMBER: Contig58301
  ref <309>: DATABASE ENTRY DATE: 2001-06-18
attattacatattaaaatttattttaaaaatacaccacatcagaaagcatattttacagtggtaaagcagcagtttttatttattacaaattctaaaaaagaatccaactttataagtaaaaaggaacactgatgatcacttaaaacatttaaatttaaaattactactaaaaaaaccctgtacattcacacaagtccaatgcctttgttggtttttacagacatagaatttctgtagggttttgggccctatcaacaatttttattaagtactgcaataacaaaatacagcaataaaacaactggacactcctaggggacaccaaagataaagggcccattaatcaggtgtaggccagagaaacccaacctgttggcaatatgacgctctttcccaactgggtcttggtgagacacgtggcacagcaaggctgtcagtgcatgtgcataaattgtagaccaggtcccactatgctacttcaggattcagccagcccttctatgagtcacagaggtcccttggtccttattcatcttgatatactcatgggatgtttggaattaaggagcccaaactaccttacttgcatttgaagtctttcacttcatatcctaccccatcagtctaagagcccacccaacaagggtagctacacatagatgctcacactctataggctgcctgatcctggaaccagcctggggccctgattatgatctccacggggctgtcagtggctagggaaagctctttaagacccagcgatcatggcagtggcatcaaccatggtgaatcaaagttaagtataatgctcccagcaaacagtgttaccagttgggttgagcaataacaaaatgcatttgaaatcagtaagactaaaccgtgtatatacaaacaataatgaatattacaaacaccaacaaccacaacaataacagatcaggcttctcaaaatccagaaaccggaag

SEQ ID NO: 2668 - DNA, 931 bp, Homo sapiens
  ref <308>: DATABASE ACCESSION NUMBER: Contig58368
  ref <309>: DATABASE ENTRY DATE: 2001-06-18
caatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggggaggagtgcgctgcgcctcaggaggcaaaggtgccccagcctgggcaggccctggaccagcccaagctgagcagcgccgcccctgggctggctctcagagcctgggctaacgtggagcccgccacgtcgcttggcactcagaggcccctgcttcttgttggctcacgtaggccacgctcaacacgtagcctgtgccacacccttcgaggcccgggtaggagggcagaggggctggtctgggctcttggtggacccctgctggtgctgcctgcctcctcctcccccacgtgggactcaagccaagggtcagaggcgcttccgctgctgggagcaagggaggagagtaggggtggagcagcctcccctctgcgtgggaacccggcctgtgtaagcagtagcgggacagggtggccggagtgatgccttggggcctgcggggaggagtggaagaagtggatgggctggctggctgtggcttgcatggcactggcagcccagcctggcttagaagtctggccggtccttcttcagcttcttatagtcagtggaaactgcaaggaacttgtattggtcattggggctcaggcggttccagggctccgggttgttctttctgtcccagcagacgtcggggctgcgaagggcgagtcgcagcaagtaaagcgcagcgctgcccatgcccaggcagattaagccgatcatcgggatgatccccggatgtcttttgatctgccggtagaagcgggccccaagactggctcctgccatatcgttgtt

SEQ ID NO: 2669 - DNA, 687 bp, Homo sapiens
  ref <308>: DATABASE ACCESSION NUMBER: Contig58471
  ref <309>: DATABASE ENTRY DATE: 2001-06-18
caccagacggtcttcaggtttatttcttaaatcaattaggaaataaaaccacagtgcccaggaaagttcacatgagacgccacggtgtctcttgccatggccccaccactccaggggccagggggtgctgctggagggaggacagacggacaggcggcctgggtggccggccccagaaaggctggcgtggatgttcgagatgagccaccagcgaagccagtagggatgtctgggccgtcctggtgggattgtctgggacatcgccaccaacacggtgtcagagccatcagtggggacatcggaggggccaccaccaggtggggtatattcaacaggctagaacccctgaggcttgagaggccaacccccggcaggagacctcccctgacccctctgctgcctctcctgtgggaccctccagtagacacaccagatgaggacacccaggaggcctcctcccaggacaggaggcagctggctgggcagccacgcagtgcagggttcagggccctccagcaggagctccatggagatggctaaatggggacatcaaggcaggggctgacagtggtgacatccaagtggtcacagtcaattccggaagctttcagggcatcaggaggggaaggtggggctggggaaatgtgacaggaacggggaagtgcaaaaggcaattgcctagcctgg

SEQ ID NO: 2670 - DNA, 1596 bp, Homo sapiens
  ref <308>: DATABASE ACCESSION NUMBER: Contig58512
  ref <309>: DATABASE ENTRY DATE: 2001-06-18
taggtaaaacaggatgtaaagtttatatacaagaatataatgtttatctgaaatatttacagtgttggttaaagcaatatttttacaacttttaaaggtaaactactatgtatattacaggtaagctacaatgggtttaatttgcaaaagttaagtaagaaatgttttaaacaaggcttaaagtactcaagtcaattataaaatttatatcttttgccttttacttgaagaaatcatgctatagaaatggttaatgtgcttctaataaatggaagtattgtagctggaatgtgatacatgtaacagtttaagttcccattgaaggtataaaatgatgaattgttgtaagacttagacactgagtctcagtctggagctgatgaagatgttgagataacagccagctttatctcaacagggtttgtgacccacaagtttgggccacagagaaaattgaagcaatttgcatgttatgacaacctcagtgggaagtgaaaatcagctgactcaaaacaacaaacaacaaccaaccagacccaagtcacagttgcacctattcaaaactagctttaaagtgagctatttttaaacttcataaaaatattcatgattttattagtttgaatatttctacaagattcgggtgggcttttcctttaggtgaaaacagctatccactcctgtggccttataactcaggaaatgctggggatgcaaacgtgcaaaaggcagggggaagctgcccaggctgagactggagcagctaggagtgtgcttggggaacgggagctgagatcccggagcagaaatggtcagccgtgctctggagcaggcctgtcggagccatcaggatgccgggactagcactgcagcttgcggatgctgcgggagatgcgcttgaactctctctgccccttctgccaccgcttcaccgaggtgatcaccagctccccaccctgtttctgtcccatgaccagatagggcgcgttgatgtcgttcatctcctcacaggtgcactgcaagctgtctttgagccacagcaccgatttcttcaggtcctttcggacacaccgttcagcttgtaaatggtcttgctcttggtctccaggatgattttggtatctcggttgatgtaggttatctccttcacttttattttcagtgcaaaatcatttttacaaagcgtttccattatgtcgttgtcatcatcatttttatttttgcaggcttcacatacctttggagcttcctcggtggctggcaggaggtggtcgctgctagcgagggggatgcaaaggtcgttgtcctgggggaaacggtcgcactcaagcatgtcgggccaggggaagccgaaggcggacatgaccggggcgcagcggtccttcacctgcacgcagagcgagtggcatggctggatggtctcgtctaggtcatcgaggcagacgggggcgaagagcgagcacaggaacttcttggtgtccgggtggcactgcttcatgaccagcgggatccaagcgccggcctgctccagcacctccttcatggtctcgtggcccagcaggttgggcagccgcatgttctggtattcgatgccgt

SEQ ID NO: 2671 - DNA, 334 bp, Homo sapiens
  ref <308>: DATABASE ACCESSION NUMBER: Contig58755
  ref <309>: DATABASE ENTRY DATE: 2001-06-18
tataaactttattattttacattcaagtgaaacttccatctggaggggctaaacacagctgccggccacattcactgatttattactttgttgcctttttcgttcacctgatggaagaattcaaccctcttaaaaacataacaacaacaaaaacagctggagagtcccagccgtaatactaggtgtagacacgcacaagcacacacacaaattcaaaaacttctacatagaaaattaaaggataaacattatccatctattttgtactgtgtaatgcaacttttatatacataaatttttttttttttactgttttcagtcactgcaatttttc

SEQ ID NO: 2672 - DNA, 469 bp, Homo sapiens
  ref <308>: DATABASE ACCESSION NUMBER: Contig59120
  ref <309>: DATABASE ENTRY DATE: 2001-06-18
gatttgggttggtttttatctctgattcttcccagtaactcatccactaagaaccctgcccacaggagggtctgatccaacggggggtttgaggccactcagctcagcctggttcccagggccagtgtcccactccagaggccaagtccatgctcccctcccctcagcaggcctgttcctccagagctgtccagtctctctgccaggctccaaattctccatcttcagtgtattgaccaaacaatgagacaggaggacagctgggagagcgggagtctgaaatcactggtagagtggcccaggacacacacaggagagagtctccaccgctgctgagatgaagggactctccattcttctcaaaaggcttgctgtgtttttggcattcccccacctgactttttttcaagtgagttgttccgatctgacctcagagaaggccaaactgggtgcatggtcatgtaggtgg

SEQ ID NO: 2673 - DNA, 459 bp, Homo sapiens
  ref <308>: DATABASE ACCESSION NUMBER: Contig60157
  ref <309>: DATABASE ENTRY DATE: 2001-06-18
catgtaccagatttttaatgcatttgaatctttattctacaacacaagcaacataaatacaatatcttttaaaatattttctctttagaattttcatttccacctcagataaaatgtacacaaaatacacttgcaagcttgcttacagagacctgttaaacaaagaacagacagattctataaaatcagttatatcaacatataaaggagtgtgattttcagtttgtttttttaagtaaatatgaccaaactgactaaataagaaggcaaaacaaaaaattatgcttccttgacaaggcctttggagtaaacaaaatgcttcaaggctcctggtgaatggggttgcaaggatgaattttgcattttataggtacaatggtatactgactcaaatcattatggctataacaagcttcatttatttataatctttcaatgaattaaggttgattctttggc

SEQ ID NO: 2674 - DNA, 604 bp, Homo sapiens
  ref <308>: DATABASE ACCESSION NUMBER: Contig60393
  ref <309>: DATABASE ENTRY DATE: 2001-06-18
tttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccgacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcagctgtggtctcctctgcaaagcattttaattaaaaacctcaataaagatggccctgcccacac

SEQ ID NO: 2675 - DNA, 420 bp, Homo sapiens
  ref <308>: DATABASE ACCESSION NUMBER: Contig60509
  ref <309>: DATABASE ENTRY DATE: 2001-06-18
aggattatgttaatactaatctattcaccagataattaggatagcatatgtcaattacctggtgaatagattagtattaacataatccttcaaaatcaaaacaactacttgtcaaaagcagagcagataaaatcttacgtgtactccggtgcagaaatcggtgcctggaaccttgaaattttatttcttggggcagaatctgatctgtgccaccttaaataataattatgcttcttttacatattcagcttttataacacaaagaaaaagctagatctgattttactgtttagaattcacttttgcgctaatagctgaccacaatcttattgcctcttcgaagtaattaagaaaacaaaggctagtgctcctgctctcatacccgttcgcacttttattcttaaagccatggaataaaat

SEQ ID NO: 2676 - DNA, 450 bp, Homo sapiens
  ref <308>: DATABASE ACCESSION NUMBER: Contig60864
  ref <309>: DATABASE ENTRY DATE: 2001-06-18
acagagtcttgaggaaatacatttctaagaaggatttttacagacactcatctttcatacccaaccacagggtctaactctaaagaggataaaaccaattactttcgtcccaagagctcatgactaatgacagcgtaaatctatgctatcaaaacctgcgtctctcatctgttacgagtattcaggcaggattcaaatattctcaaagaaagaaacacagtgcatgctgtgatcgcctgctcagcaacaacaagcactgcatcccaaactatctcctcccaggaattaaatgaggccagttgtgtacactggcatttcctccactgtggtactgcagaaggtctcagtgtcacaaagaatccttttgtcttctttaatatttatggtcacagctgtcttcccaagttgaccccgactgccagttcaacaagtcagtagcagtcaaaatat

SEQ ID NO: 2677 - DNA, 368 bp, Homo sapiens
  ref <308>: DATABASE ACCESSION NUMBER: Contig61254
  ref <309>: DATABASE ENTRY DATE: 2001-06-18
cgactcactatagggcaaaacttttttttttttttttttgcccagccagaaaatctttaattgacaaatatttaagggacaagagggttttaagaaattaaaaggatgtatgaagtgaagtgagttgtgaacagaacctgggtgccctcctcatccacgtgcctcagtcgccctcgtgcctgaccggctttgccaatggagcctggaccctcagcacgggtcagctgtgggtgcgaacatggtggtctgggtcaggcctctttcaagtccccacaacaggcctgacttgtgcgtgagacgctttcaccttaaaccccacgccatcctgggggttcatggtcaggtataaaaccctgcagagaagtcag

SEQ ID NO: 2678 - DNA, 359 bp, Homo sapiens
  ref <308>: DATABASE ACCESSION NUMBER: Contig61815
  ref <309>: DATABASE ENTRY DATE: 2001-06-18
tcaaaaagctttatttccatttggtccaaggcttgttaggatcacagatgagaggcagactgagattcaagcttgggtgacctgcctcaaatgcttaggttctttttgccaccacgagcttctcctggggtagggcttgggggtggcccatggtgctaatgcatgtggggtgctgaccggctttccctctgggagtccaggtggcgcatattagcagaggggccagggactccttggatccagggcgtgtccttagggtctcagccttgagggtgtaaaagctaaagtgagtgtccgggtggataagggacttggataggatcctgccgtgtgggctggggtgggtacagcaagatgcc

SEQ ID NO: 2679 - DNA, 713 bp, Homo sapiens
  ref <308>: DATABASE ACCESSION NUMBER: Contig61975
  ref <309>: DATABASE ENTRY DATE: 2001-06-18
gtgaaaagtctcacccaggaggaacagccctccttgaagcaatggcagggcagcagggaggtgggcatggcagggaatggagagagtgagccagacagacttcacctccttactggacacagggtcactggcgagtttcaattgctgctccctttactttctctacctgtgactactccctggaccaatcctgaggagggcacaatttccagaagccacgtgataggggctggtttctgtggagccagaggatgagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctc

SEQ ID NO: 2680 - DNA, 760 bp, Homo sapiens
  ref <308>: DATABASE ACCESSION NUMBER: Contig62306
  ref <309>: DATABASE ENTRY DATE: 2001-06-18
ttaaatgaagcaacatagtgagacgtcgtctctacaaaaaaaaaaagaaaaaaaaaattagccaggcatgcgaaacgctgaggtgggaggatcagatgagcttgggaggttgaggctgcagtgagccttggtcatgccactactgtgttctagtctgggcaacagagtgagaccttctctcaaaaaaaaaacccaaaattgtagaattacttctatagctatattttatgataaagaagtgattgtttctcaaaatcgcattttaaagacgttttatggtacttgttggaattgggacttaggagttttgattttgataagaaactgggataattttctgaactttttttcctctgtatcacatttatttactatttttaaaaactttgacatttaacacttgggacaacatttattataaatgataagaaaaatcttagaggtttgtctacccacagtgtcatggaatcttctttgaaaactaatccataaagtccctggagaaattggtcagaatgatctgtcagaaccatttgaaaacttgctcaagagcagttgcttatatatagtaggattttactttttcctgcttatgtactactatatgcttaaaaaacctggaggaatacttaccaaagaggagtaaccatctctgagggtgggattctgggggaatttttgtttttttctgttttctataatgtgaaacttttgtagtatgtatttttctaattgaagagaataaagattaaaacaagta

SEQ ID NO: 2681 - DNA, 508 bp, Homo sapiens
  ref <308>: DATABASE ACCESSION NUMBER: Contig62568
  ref <309>: DATABASE ENTRY DATE: 2001-06-18
gactcataaagtgctctttattggcatctgaaaaagaagtgcctcagccttcaaggctgggacagaagttggggaggagctgctctgccccaggctcaataccaatagaccttcttgtatttccgggtctccttgatccccatggcctccatcacctcctcctgcagtgtctttagacagggcacataggttctttctaaagcatcttccactgatgtgtctttggggccatcaatccacgtttcagggacgatgccatcagctctgggaaattcgggtttagggataattctccctgatcgtgtggagactcgtacccgctctcctgcttcagtaaatctccactcgatctcagtgggtttcctgtccataggatccacaagtttgacctggcggtggagcaagggggcttcactagggatcatggttccccggtaatccatggtcttgccaatgtagcggtaatgtgtgttcagccctcccacgaccacccagtttcgctgccgga

SEQ ID NO: 2682 - DNA, 736 bp, Homo sapiens
  ref <308>: DATABASE ACCESSION NUMBER: Contig62922
  ref <309>: DATABASE ENTRY DATE: 2001-06-18
aagggagaacagttttattagcatcacagggtccatttttccctttccatccaagcatccagagtctggtgtcctttaatcagttggcaggttcaacctggaggccactggagctgccggcccccaagtacatgaatgtgcagatgatacacagattgtgcacccagcttcccatcgttgatcactgaaattgagcttggggttagggagtcaggatcatggcagaggtcgaagaatgaagatcatattgagaagtaggaatgagaattcataggtgagggaccaagggccaaaagtcactcaccaagtcggtatccatctcccaggccctcagcctttgctgtctgcttggccacaaggagtaggtgtcctagaagctgctggtcttcttcttcagcctggctaatccgaggaatgggcttcttaggaatgaccaggaagtgcacaggagcctgaggggccacatcacggaacacaagacactgctggtcctcatagagaatgtcagctgggaggctcttgtccaggatccgggagaagatggttggggctgctcccccaggagttgcctgctgcgccttggccacttcattcccatcagtcacacctgcagctcctcggacctgccccccgcgcacccccgtggccgccacggctctgcgccgcgcgcaacccagcagccagcaccaccgtgccgccatcttccctgagccgcgggaacctctcacccgggtca

SEQ ID NO: 2683 - DNA, 708 bp, Homo sapiens
  ref <308>: DATABASE ACCESSION NUMBER: Contig62964
  ref <309>: DATABASE ENTRY DATE: 2001-06-18
cagtgtacagatacgtttattgacaaataaagtacatgtacccctacacaagtatcactgcgacatttcaggaaccttggagctgggaacgccccttcctccctgcccgcctcttctctagcctcctcctgattgggcttgggctctctagaaaagtgcttctggcattgtctcgctggaaactctgtaggtgtgctggttgggctctcagtgtttatcatgtccacacccttctgtccctgggagctgtggacaaggggcgatgagcctgctcagtcattcatgtccagcccaaactctggatacaactctttggtggtgacacctcggatcacagctagtttgcccatcagcatctgccccacatccttgatgtcattgtactcgtgaagctgggtaatgtggtcctccagttcatccacactgtagccttcagatacgaactgggagatctccttgtccagcatgtccctcttctccttcagtttctgaatgtcaaggtgcagagactcctcgctggtcccatcagcctggccagacttgggcaatggcctaggggatcggaaggccccgcggcaacttcgggtaagtcttggttcagtcctcctgagccctgggtccgaggcccccggatcagggggttcaatggcgcaagagggtccagcgcgggagtcggagagcgacctctcaggtgcaccgggccaggaa

SEQ ID NO: 2684 - DNA, 449 bp, Homo sapiens
  ref <308>: DATABASE ACCESSION NUMBER: Contig63102
  ref <309>: DATABASE ENTRY DATE: 2001-06-18
ctatcccattttttcatttatttttatgaggagcctcaaaaaatagaagtggccttggtagggaaggaatgtcgtgattctgagtacagtatggcaaattcttttgcctcagtttccctaactccatccagtgcatatgaaaatgtctatgtgcgtacaaggtaggtctggactaagctctggccctccggttgttttcccattgcgggagcctaagccagggtgcccaggactcctgtgtggctggtgggcctgatgcccacagctgatgattcaggaaggaggggcctggagtctgctgcagactctcccgccccctacagcccaaaccgggcactgcagcaatgaggtggtcagtccagggagaggtccgacaagttctcggcacaatgctgcaggaagtcaaagtcaggcacggagaagggcacgcgggaccactttttggcctg

SEQ ID NO: 2685 - DNA, 610 bp, Homo sapiens
  ref <308>: DATABASE ACCESSION NUMBER: Contig63520
  ref <309>: DATABASE ENTRY DATE: 2001-06-18
aaattaaataaacttttattttggaatgatactagatttacagagaagttgcagagatagtacaaagagttcctgtatacccttcacccagcctaccccaaggtcaacatcttacatcaccatggtacatctgtcaaaaccaagagactgaaattggtatattaactaaaattcagacttttttcagatttccaattttcccactaatgtcctgtttttgttccaagacccaatccaggatgccacattgcactgaagacactctcccttttcaattctattactggtcacctcagtcaactttcccggggaaagagaatgcatgggaaaagctcttgtccttattattgaactggagaaactgaggcttaaaagtgccgagtgaccaagttcccttagagggcagtgagaacaaggcctgccttactctgttccctttccccagggactcttggttttcagaagcccctctggaatgtcctacctggcctaaccccataccagcagtgcagacaaggaggcactcctactacagtgggtccagcccatggagagactcacttcctgccccaacacctcttcccctagaccctgagggccaggacaatgt

SEQ ID NO: 2686 - DNA, 859 bp, Homo sapiens
  ref <308>: DATABASE ACCESSION NUMBER: Contig63649
  ref <309>: DATABASE ENTRY DATE: 2001-06-18
tttttttttttttttttttgagttgctgaaaagtttacttttgagttttaaactgtactttgaaaactatattgtgaactgtgttgacatgaggaaaggctgggctccctgaaaacatccagttccacagcagggcgtgcccaagcccagccaatccccaggcaatgcagggcagggatcccacctggtataagtacgggcagagggcagagcagggctgtatcgaggggcggcgctgggaccctcctcgcccagagttcctactcatccccagcacagaagtgctctgtagggccagctgaggacaccccggttcactgagggtggcccacagtaagtcgccgtctggcagtaagttagctctggcaggtgtggacccaagaccacacacagcctttctcaggtgcaggtcctccaagcctcacttcgcagtggtgacaggcaacccgtcagggcagggagcttccaaaggccagtccgagtccatgccaggcgtccactaaatctgcctctccctctccagcgagcaggtgcagccctcaactcctgcaggcctggggagcggagacagggcctgtaggctcggacacgacccggtcctgattttaacagtagacttgagaaggcaggctcagcagacaggctgctggaggatccacccgctgtctcccgcagcggccccactgaagcggcagaaacacacagaagcaccaaatctgtcactctcttcccgtaggaagtccccagaggtggccctccggaggatggtcctgttggctgaagatatgaccacacctgtgcctgcccagggccaccttcagcttggcaacaggaactccgcacactggtaccctgcgac

SEQ ID NO: 2687 - DNA, 541 bp, Homo sapiens
  ref <308>: DATABASE ACCESSION NUMBER: Contig63683
  ref <309>: DATABASE ENTRY DATE: 2001-06-18
aatgtctcacgaaggtttatttgaatagagttacatctagagttctcatttcagtgtacaaacaactcagtgcagtgtttctaatacaagtcatataaaactggaacacactaaatgaatagtgcacttgatagaaaaataaattacactttaaatgctactgcaaagttttacacatataaaaggtaaacacaaaatagttagtgagaccctcataaccacttatcatatccagataaggagataaaaggggcaaaggaatctgtgctataaaaaaaaatctctctgaagaggagaaatcctgacaagtaactgaatgatcatctcaagcaatgtggtgacatagggacttacagatcgtatctcttagaactgggaaggaatcatagctctaccaatgtgttaacacaacccagttcagctcagggcaaatttctataattcaaacaaatgtcctcatactaacgcctaatatgtaggaaaagtttccaactttcttctgaccactgaagaggtacagtgtttaaatttttgagaggat

SEQ ID NO: 2688 - DNA, 351 bp, Homo sapiens
  ref <308>: DATABASE ACCESSION NUMBER: Contig63748
  ref <309>: DATABASE ENTRY DATE: 2001-06-18
gggcagacagaaggctttgttactgccaccgggcaggagacacagggtcagggttccagggccaagttatccactcccttgggtctttccttcctggggctttccctgcggggcccgggggagctgcagcagcagcagtgggcgacgaccagcagcagcaggagcagcacggtgcccatgaaggtgaggaaaacaatgaaggcaacagtgtcccatgtggactggaaaaactggtggctcttcagtctccccaggacttcctgaaccgtggcctccagctcctctgtggacacagccatcttggcgtgcaccgtgccacctcctagaagcctccaattcccccaaccaggc

SEQ ID NO: 2689 - DNA, 646 bp, Homo sapiens
  ref <308>: DATABASE ACCESSION NUMBER: Contig64502
  ref <309>: DATABASE ENTRY DATE: 2001-06-18
gcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaa

SEQ ID NO: 2690 - DNA, 632 bp, Homo sapiens
  ref <308>: DATABASE ACCESSION NUMBER: Contig64688
  ref <309>: DATABASE ENTRY DATE: 2001-06-18
aagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagccataataaacttgtaaaattaag

SEQ ID NO: 2691 - DNA, 938 bp, Homo sapiens
  ref <308>: DATABASE ACCESSION NUMBER: Contig64775
  ref <309>: DATABASE ENTRY DATE: 2001-06-18
ttttttttttttttttttattgttttaaaattttatttataaataaaagatatatacatatgtgctttaatatgattaacaggttccattttgtacaaaatgttaaacctagagtcctctgcgtcctggatgaggcgtccaaagggtggaatagtacagcattaggacctttgttctcctcttggcttctggaagagaaactcttgcatgccctcgactttcaccgcaaaaataagtgagaaaaaagataaatcccatttatgcaatgatatgtagctatgagttaatcacggtatttcattccatgaaatccattaagctgctggcatttgcatggctctaagtttattttaagaggctcattcaaacatggccaggaatatattggcctcttgagagtttgcatggcaaggagttatacagcaggaaaaagaaaaaaaacccaataattatattgatgcaagattcatcagtattttagaatattgtcgtttcaacatgttaaattgtttctgagcactgctgatttcagcactgtccctggtccacgtgacgcaaatgccaccctttccatatattcttcagcaaaaatatatgaaaagcccgtcactccctaagaggaccctgatccctctggagaggaaaactaaactctttaagaagaaaaccaaacccaacctgaactaatcgtccaaggagtcctgtttggtcccacgaaaggcagatttccatccacaccagtgaggggcaagtgtccgggttccaactcgaagccaggcgggcctgtgcgggggtgagtcctttgccacccggcgccccccaggctctacaagcgtctagaggtcggagtcgcagggcagcgagtgtcgcaggggtgggtgctgcacgagggagcgtcctgggactcccacccctcccgtcgaggacgtccaccgagt

SEQ ID NO: 2692 - DNA, 726 bp, Homo sapiens
  ref <308>: DATABASE ACCESSION NUMBER: Contig65227
  ref <309>: DATABASE ENTRY DATE: 2001-06-18
taggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagccaaaaaaaaaaaaa

SEQ ID NO: 2693 - DNA, 805 bp, Homo sapiens
  ref <308>: DATABASE ACCESSION NUMBER: Contig65663
  ref <309>: DATABASE ENTRY DATE: 2001-06-18
agattagtgcagcccggagcttgagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaa

SEQ ID NO: 2694 - DNA, 718 bp, Homo sapiens
  ref <308>: DATABASE ACCESSION NUMBER: Contig65785
  ref <309>: DATABASE ENTRY DATE: 2001-06-18
cacaggtttgtcttttaatcagcatccatgaaaattcattaaaaggtctgatacgaaaagcaccaggctaacaaatcagtcctgaattcaattttacaaaaacaccctctcctcttccatctcatccctaatattcctacgttatctcgaggtgcagagaaatataaaagggatccttgacataaaaacgtattaaaaagccaccatgagtagaatgtacggtaacagcgtctgactcggccggcaggacaggaaacctacagaaccaccatgccagggctttgtgtgagcaggcgggcactccacatgggcacgtgtgtgagcaggcaggcactccacatgggcacgtgtgagcaggcgggcactccacatgggcacgtgtgtgagcaggcgggcactccacatcggcacatgtgagcaggtgggcactccacatgggcacatgagcaggtgggcactccacatggacatgtgtgtgagcaggcgggcactccgcatcgacatgtgtgagcaggtgggcactccacatgggcacatgagcaggcgggcactccacatgggcacgtgtgagcaggcgggcactccacattggcacaaagcgagggctcatgcataagaggtgcagggacacctggacagctatttgaaatttaaaaactgggtttcctggctcacattttgtatcaaaaactagaagtagatcaatgatttcaatatg

SEQ ID NO: 2695 - DNA, 696 bp, Homo sapiens
  ref <308>: DATABASE ACCESSION NUMBER: Contig65900
  ref <309>: DATABASE ENTRY DATE: 2001-06-18
ctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattgg

SEQ ID NO: 2696 - DNA, 501 bp, Homo sapiens
  ref <308>: DATABASE ACCESSION NUMBER: Contig66219
  ref <309>: DATABASE ENTRY DATE: 2001-06-18
tcaaatgtatcagtttattaaaaatgcagcatttttcacatgagctttaaagatgtggaagatggggtacaattaaaaccatgagagttgtgcagggaacagccgtagggcctgtttgcaccttcagatattgcctgctcccaaaaattcagacccccagatgcagggcaagacaataagaaagggtgagtgcaagcaaggagagcctcctgctaagaggctgaggtcccctctggttccaaggatgggatgtcagccttgaccttccggggtctgcagtggccagaggctgcctgtcgccccttcctcctccccttcttgggcactgtgggagcttctgggtcctgctggaggctggtcccctcaggccgctgggttgcagtcctcttaggaaggtctctctttgcccttcgtgtcctggaaggggccttgcttggaggcaaagcgtcctccactctgtcctcaggactcagctgtgtggccttggatttctttttgcgg

SEQ ID NO: 2697 - DNA, 447 bp, Homo sapiens
  ref <308>: DATABASE ACCESSION NUMBER: Contig66705
  ref <309>: DATABASE ENTRY DATE: 2001-06-18
cacaccgctaagggctttatttcacagatcatggtggtgagtttggatttccagccctcaccacggttaagtcacacatttcccgacacctgctcatttctccagatctgaaacatctcacccaacacatcctagttgttgtaaaccccaaatgaactttccagaagcaaaaacaataacagattcagagaaccctggtcacacctgctgagcaggtcccctctactctggttgcatatagaatgcttgtttgctcaaaagagaggcgctctcaacatcaaggcacaaagaaagacgtctccaggggcaaaatgatgacgaagtgaccagcggcctctgcgaggcccgaggcagagtcacgggggaggcgagttcagcctgacgggcattgggaggaagagccaaggacaggtctcccgctggggctcaggcgtcctcacgcgtact

SEQ ID NO: 2698 - DNA, 956 bp, Homo sapiens
  ref <308>: DATABASE ACCESSION NUMBER: Contig66759
  ref <309>: DATABASE ENTRY DATE: 2001-06-18
gaggagatggcacagaataagcaatttattgcaattgaattatccaatgtggttgactgaatataaatatttttattacaaaatattccaggtaaaaattcggagctgcttacaagcttctttagctttaagctcattgcatttcttcatgtctagagcatgggtgacgggctcaggtgtgcctggcctgccccgcagggtcctccttctccgtctgcagtgggtcccactcagtgaggacctctgaggacacctcagtgaacagatggtcccagtcccagccgacatcatcctgccaagaagggtttcgctgggtaagacaaagaaaggccttttccctcaactgtagctgacttctccctcccatccaggcctcagggaggcacaggccagcccgggagtcggctggttatgggaatgccagagctgagagaccggggaattgctgccaccactgtacctcccggacttcgtgctccggcgcgagcactttggtgaggagtttcaggtcgatctccccatccagtgtctgaatggctgagtacttcatgaggtcattgtccaggtcacggtaggtcatcacccgctttatctggatgctgggaggggctgccacctgcaaaacaaagtcttcttcctgtacttcctccagatccggaatgataggaatatctcctccataatctgatccattcaggctctgtggtctgaggcggaaatcttctatttcttcagaagccttcctcctaaacttcgaagccttcacggaatcacctgcccagcctcctgtcggcagcgaggtaatttagcagaggaagtctctccagtcagagtcaaagaggaattcttgccattgaggtgattctcggcctgcgctgactcctgttgagctcggcgacccatcttggccctggaggtagccaagctgtagcgaagctcctcgtccaagtcgagca

SEQ ID NO: 2699 - DNA, 377 bp, Homo sapiens
  ref <308>: DATABASE ACCESSION NUMBER: Contig67182
  ref <309>: DATABASE ENTRY DATE: 2001-06-18
gatttaaaaaagatttatttacttgttgaatatttattagtagtagtagtaataaatataaccccgaagccacaaataaccttaggattctctcagctttaatggcagtagagtccagcttcttaatcttttgcacaaaatacactcaaggaggagctatccataagactaatagaagacttttgtctccctgacccagctcctctaatttcatatgggaaacacctaacagccataaagtgatgatctgggagtcctcattagagatgggctggacatgtcagaaagctgaagaaagaaatcaacctatttgtgaaccttaccatctaaaattgttagtctgtgtcttctaaataaacagagacctttttctcttg
